(12) United States Patent
Roos et al.

(10) Patent No.: US 11,384,375 B2
(45) Date of Patent: Jul. 12, 2022

(54) IMMOBILIZED POLY(N)POLYMERASE

(71) Applicant: CureVac AG, Tübingen (DE)

(72) Inventors: Tilmann Roos, Kusterdingen (DE);
Benyamin Yazdan Panah, Tübingen (DE); Markus Conzelmann, Tübingen (DE); Veronika Wagner, Ellwangen (DE)

(73) Assignee: CureVac AG, Tübingen (DE)

(*) Notice: Subject to any disclaimer, the term of this patent is extended or adjusted under 35 U.S.C. 154(b) by 0 days.

(21) Appl. No.: 15/570,195

(22) PCT Filed: May 2, 2016

(86) PCT No.: PCT/EP2016/059794
§ 371 (c)(1),
(2) Date: Oct. 27, 2017

(87) PCT Pub. No.: WO2016/174271
PCT Pub. Date: Nov. 3, 2016

(65) Prior Publication Data
US 2018/0142275 A1    May 24, 2018

(30) Foreign Application Priority Data

Apr. 30, 2015 (GB) .................................... 1507504
Apr. 30, 2015 (WO) ................. PCT/EP2015/059611

(51) Int. Cl.
*C12N 9/12* (2006.01)
*C12P 19/34* (2006.01)
(Continued)

(52) U.S. Cl.
CPC ............ *C12P 19/34* (2013.01); *C12N 9/1241* (2013.01); *C12N 11/02* (2013.01); *C12N 11/06* (2013.01);
(Continued)

(58) Field of Classification Search
None
See application file for complete search history.

(56) References Cited

U.S. PATENT DOCUMENTS 6,201,112 B1    3/2001  Ach
7,238,505 B2 *  7/2007  Hwang ................ C12N 9/1252
                                                    435/177

(Continued)

FOREIGN PATENT DOCUMENTS

CN           104560706      4/2015
WO       WO 1993/011227    6/1993
(Continued)

OTHER PUBLICATIONS

See Ngo et al. in The Protein Folding Problem and Tertiary Structure Prediction, 1994, Merz et al. (ed.), Birkhauser, Boston, MA, pp. 433 and 492-495.*

(Continued)

*Primary Examiner* — Richard G Hutson
(74) *Attorney, Agent, or Firm* — Parker Highlander PLLC

(57) ABSTRACT

The present invention relates to an immobilized poly(N) polymerase (PNP), methods of producing said PNP and uses thereof. Further disclosed is an enzyme reactor and kit comprising the PNP for producing polynucleotidylated ribonucleic acid poly(N)RNA)molecules which are useful in gene therapy, immunotherapy, protein replacement therapy and/or vaccination.

17 Claims, 11 Drawing Sheets
Specification includes a Sequence Listing.

(51) Int. Cl.
| | |
|---|---|
| *C12N 11/06* | (2006.01) |
| *C12N 11/14* | (2006.01) |
| *C12N 11/02* | (2006.01) |
| *C12N 15/10* | (2006.01) |
| *C12N 15/113* | (2010.01) |
| *C12Q 1/6806* | (2018.01) |

(52) U.S. Cl.
CPC .......... *C12N 11/14* (2013.01); *C12N 15/1006* (2013.01); *C12N 15/113* (2013.01); *C12Q 1/6806* (2013.01); *C12Y 207/07019* (2013.01); *Y02P 20/50* (2015.11)

(56) References Cited

U.S. PATENT DOCUMENTS

| | | | | |
|---|---|---|---|---|
| 8,574,840 | B2* | 11/2013 | Kotseroglou | ........ C12Q 1/6869 435/6.1 |
| 8,808,989 | B1* | 8/2014 | Efcavitch | ................. C12P 19/34 435/6.1 |
| 2004/0086889 | A1 | 5/2004 | Hwang | |
| 2004/0235001 | A1 | 11/2004 | Wang et al. | |
| 2005/0032730 | A1 | 2/2005 | Von der Mulbe et al. | |
| 2005/0059624 | A1 | 3/2005 | Hoerr et al. | |
| 2005/0250723 | A1 | 11/2005 | Hoerr et al. | |
| 2006/0188490 | A1 | 8/2006 | Hoerr et al. | |
| 2008/0025944 | A1 | 1/2008 | Hoerr et al. | |
| 2008/0171386 | A1 | 7/2008 | McKnight et al. | |
| 2008/0267873 | A1 | 10/2008 | Hoerr et al. | |
| 2009/0324584 | A1 | 12/2009 | Hoerr et al. | |
| 2010/0048883 | A1 | 2/2010 | Ketterer et al. | |
| 2010/0189729 | A1 | 7/2010 | Hoerr et al. | |
| 2010/0203076 | A1 | 8/2010 | Fotin-Mleczek et al. | |
| 2010/0291156 | A1 | 11/2010 | Barner et al. | |
| 2010/0305196 | A1 | 12/2010 | Probst et al. | |
| 2011/0053829 | A1 | 3/2011 | Baumhof et al. | |
| 2011/0250225 | A1 | 10/2011 | Fotin-Mleczek et al. | |
| 2012/0021043 | A1 | 1/2012 | Kramps et al. | |
| 2012/0040395 | A1 | 2/2012 | Clendennen | |
| 2012/0214171 | A1 | 8/2012 | Kotseroglou | |
| 2012/0258046 | A1 | 10/2012 | Mutzke | |
| 2013/0129754 | A1 | 5/2013 | Thess et al. | |
| 2013/0142818 | A1 | 6/2013 | Baumhof et al. | |
| 2013/0259879 | A1 | 10/2013 | Baumhof et al. | |
| 2013/0280283 | A1 | 10/2013 | Lorenz et al. | |
| 2013/0295043 | A1 | 11/2013 | Kallen et al. | |
| 2013/0336998 | A1 | 12/2013 | Kallen et al. | |
| 2014/0370496 | A1* | 12/2014 | Mizutani | ................. C12Q 1/703 435/5 |
| 2015/0037326 | A1 | 2/2015 | Butler-Ransohoff et al. | |
| 2015/0050302 | A1 | 2/2015 | Thess | |
| 2015/0057340 | A1 | 2/2015 | Thess et al. | |
| 2015/0093413 | A1 | 4/2015 | Thess et al. | |
| 2015/0118183 | A1 | 4/2015 | Baumhof | |
| 2015/0118264 | A1 | 4/2015 | Baumhof et al. | |
| 2015/0165006 | A1 | 6/2015 | Thess et al. | |
| 2015/0184195 | A1 | 7/2015 | Thess et al. | |
| 2015/0218554 | A1 | 8/2015 | Thess | |
| 2015/0306249 | A1 | 10/2015 | Baumhof et al. | |
| 2015/0320847 | A1 | 11/2015 | Thess et al. | |
| 2016/0130345 | A1 | 5/2016 | Fotin-Mleczek et al. | |
| 2016/0166668 | A1 | 6/2016 | Kallen et al. | |
| 2016/0166678 | A1 | 6/2016 | Kallen et al. | |
| 2016/0166710 | A1 | 6/2016 | Baumhof | |
| 2016/0166711 | A1 | 6/2016 | Schnee et al. | |
| 2016/0168207 | A1 | 6/2016 | Kramps et al. | |
| 2016/0168227 | A1 | 6/2016 | Kallen et al. | |
| 2016/0235864 | A1 | 8/2016 | Schlake et al. | |
| 2016/0304883 | A1 | 10/2016 | Wochner | |
| 2016/0304938 | A1 | 10/2016 | Wochner | |
| 2016/0326575 | A1 | 11/2016 | Von Der Mulbe et al. | |
| 2016/0331844 | A1 | 11/2016 | Fotin-Mleczek et al. | |
| 2017/0014496 | A1 | 1/2017 | Fotin-Mleczek et al. | |
| 2017/0029847 | A1 | 2/2017 | Thess | |
| 2017/0114378 | A1 | 4/2017 | Wochner et al. | |
| 2017/0252430 | A1 | 9/2017 | Fotin-Mleczek et al. | |
| 2017/0326225 | A1 | 11/2017 | Rauch et al. | |
| 2018/0044687 | A1 | 2/2018 | Thess et al. | |

FOREIGN PATENT DOCUMENTS

| | | |
|---|---|---|
| WO | WO 2001/025418 | 4/2001 |
| WO | WO 2007/075987 | 7/2007 |
| WO | WO 2016-107877 | 7/2016 |
| WO | WO 2016-165825 | 10/2016 |
| WO | WO 2016-165831 | 10/2016 |
| WO | WO 2016-174227 | 11/2016 |
| WO | WO 2016-184575 | 11/2016 |
| WO | WO 2016-184576 | 11/2016 |
| WO | WO 2016-184822 | 11/2016 |
| WO | WO 2016-193206 | 12/2016 |
| WO | WO 2016-193226 | 12/2016 |
| WO | WO 2016-203025 | 12/2016 |
| WO | WO 2017-001058 | 1/2017 |
| WO | WO 2017-009376 | 1/2017 |
| WO | WO 2017-021546 | 2/2017 |
| WO | WO 2017-025120 | 2/2017 |
| WO | WO 2017-025447 | 2/2017 |
| WO | WO 2017-036580 | 3/2017 |

OTHER PUBLICATIONS

Grazu et al., Biotechnology and Bioengineering, vol. 90, No. 5, pp. 597-605, Jun. 2005.*

Stetler et al., Proc. Natl. Acad. Sci. USA, vol. 78, No. 12, pp. 7732-7736, Dec. 1981.*

Mohanty and Kushner, MolecularMicrobiology vol. 34, No. 5, pp. 1094-1108, 1999.*

Kashlev et al., Gene, vol. 103, pp. 9-14, 1993.*

New England Biolabs catalog entry (https://www.neb.com/protocols/2014/08/13 Poly(A) Tailing of RNA using *E. coli* Poly(A) Polymerase (NEB# M0276).*

Arai et al., Protein Engineering, vol. 14, No. 8, pp. 529-532, 2001.*

Gershon et al., "Stable chelating linkage for reversible immobilization of oligohistidine tagged proteins in the BIAcore surface plasmon resonance detector," *J. Immunol. Methods*, 183(1):65-76, 1995.

International Preliminary Report on Patentability issued in corresponding PCT Application No. PCT/EP2016/059794, dated Oct. 31, 2017.

International Search Report and Written Opinion issued in corresponding PCT Application No. PCT/EP2016/059794, dated Jul. 1, 2016.

Kerwitz et al., "Stimulation of poly(A) polymerase through a direct interaction with the nuclear poly(A) binding protein allosterically regulated by RNA," *EMBO*, 22:3705-3714, 2003.

Balbo and Bohm, "Mechamsm of Poly(A) Polymerase: Structure of the enzyme-MgATP-RNA ternary complex and kinetic analysis," *Structure*, 15(9): 1117-1131, 2007.

* cited by examiner

A

B

IMMOBILIZED POLY(N)POLYMERASE

This application is a national phase application under 35 U.S.C. § 371 of International Application No. PCT/EP2016/059794, filed May 2, 2016, which claims benefit of International Application No. PCT/EP2015/059611, filed Apr. 30, 2015 and United Kingdom Application No. 1507504.7, filed Apr. 30, 2015, the entire contents of each of which are hereby incorporated by reference.

FIELD OF THE INVENTION

The present invention relates to a poly(N)polymerase (PNP) which is immobilized, methods of producing said PNP and uses thereof. Further disclosed is an enzyme reactor comprising the PNP for producing polynucleotidylated ribonucleic acid (poly(N)RNA) molecules which are useful in gene therapy, immunotherapy, protein replacement therapy and/or vaccination. In addition, the present invention relates to a kit comprising the PNP.

BACKGROUND OF THE INVENTION

Gene therapy and genetic vaccination belong to the most promising and quickly developing methods of modern medicine. They may provide highly specific and individual options for therapy of a large variety of diseases. Particularly, inherited genetic diseases but also autoimmune diseases, cancerous or tumour-related diseases as well as inflammatory diseases may be the subject of such treatment approaches. Also, it is envisaged to prevent (early) onset of such diseases by these approaches.

Therapeutic ribonucleic acid (RNA) molecules represent a promising class of drugs. RNA-based therapeutics include messenger (mRNA) molecules encoding antigens for use as vaccines (Fotin-Mleczek et al., 2012, J. Gene Med. 14(6): 428-439). In addition, it is envisioned to use RNA molecules for replacement therapies, e.g. providing missing proteins such as growth factors or enzymes to patients (Karikó et al., 2012, Mol. Ther. 20(5):948-953; Kormann et al., 2012, Nat. Biotechnol. 29(2):154-157). Furthermore, the therapeutic use of noncoding immunostimulatory RNA molecules (Heidenreich et al., Int J Cancer. 2014 Dec. 21. doi: 10.1002/ijc.29402.) and other noncoding RNAs such as microRNAs and long noncoding RNAs is considered (Esteller, 2011, Nat. Rev. Genet. 15 12(12):861-74).

RNA-based therapeutics exhibit some superior properties over DNA cell transfection. As generally known, transfection of DNA molecules may lead to serious problems, such as the risk that the DNA integrates into the host genome which may influence the expression of the host genes and may possibly trigger expression of an oncogene or destruction of a tumor suppressor gene. Furthermore, a gene (and thus the encoded protein) which is essential to the host, such as a gene involved in regulation of cell growth, may also be inactivated by integration of the foreign DNA into the coding region of the respective gene. Hence, there is a number of risks associated with the application of DNA to a patient. These risks do not occur if RNA, particularly mRNA, is used instead of DNA.

Another advantage of using RNA rather than DNA is that no virus-derived promoter element has to be administered in vivo and no integration into the genome may occur. Furthermore, there is no need for RNA to overcome the barrier to the nucleus. Using RNA instead of DNA for gene therapy or genetic vaccination minimizes or even avoids the risk of undesired genomic integration and generation of anti-DNA antibodies.

However, RNA is a rather unstable molecular species which may readily be degraded by ubiquitous RNAses after administration. In vivo, RNA-degradation influences RNA half-life and is thus a mechanism to regulate eukaryotic gene expression (Friedel et al., 2009, Nucleic Acid Research, 1-12). Each naturally occurring mRNA has its individual half-life depending on the gene from which the mRNA is derived.

On the one hand, unstable RNAs are important to realize transient gene expression at distinct points in time, whereas long-lasting RNAs may be associated with accumulation of distinct proteins or continuous expression of genes.

For gene therapy and genetic vaccination, stable RNA is desired. This is, on the one hand, due to the fact that the product encoded by the RNA-sequence shall accumulate in vivo. On the other hand, the RNA has to maintain its structural and functional integrity when prepared for a suitable dosage form, in the course of its storage, and when administered. This is also decisive for regulatory approval.

It has been reported that the G/C-content of nucleic acid molecules may influence their stability. Thus, nucleic acid molecules comprising an increased amount of guanine (G) and/or cytosine (C) residues may be functionally more stable than nucleic acid molecules containing a large amount of adenine (A) and thymine (T) or uracil (U) nucleotides. In this context, WO 02/098443 provides a pharmaceutical composition containing an mRNA that is stabilized by sequence modifications in the translated region. Such a sequence modification takes advantage of the degeneracy of the genetic code. Accordingly, codons which contain a less favorable combination of nucleotides (less favorable in terms of RNA stability) may be substituted by alternative codons without altering the encoded amino acid sequence. This method of RNA stabilization is limited by the provisions of the specific nucleotide sequence of each single RNA molecule which is not allowed to leave the space of the desired amino acid sequence. Also, that approach is restricted to coding regions of the RNA.

As an alternative option for mRNA stabilization, it has been found that naturally occurring eukaryotic mRNA molecules contain characteristic stabilizing elements. For example, they may comprise so-called untranslated regions (UTR) at their 5'-end (5'UTR) and/or at their 3'-end (3'UTR) as well as other structural features, such as a 5'-cap structure or a 3'-poly(adenylate) tail (also denoted poly(A) tail or poly(A) sequence). Both, 5'UTR and 3'UTR are typically transcribed from the genomic DNA and are, thus, an element of the premature mRNA. Characteristic structural features of mature mRNA, such as the 5'-cap and the 3'-poly(A) tail are usually added to the transcribed (premature) mRNA during mRNA processing.

A 3'-poly(A) tail is typically a monotonous sequence of adenine nucleotides, which is enzymatically added by poly (A) polymerases (PAP) to the 3'-end of the nascent mRNA. The poly(A) sequence is added to the 3'-end of RNA molecules by the ubiquitous cleavage/polyadenylation machinery. After cleavage, most pre-mRNAs, with the exception of replication-dependent histone transcripts, acquire a polyadenylated tail. In this context, 3'-end processing is a nuclear co-transcriptional process that promotes transport of mRNA from the nucleus to the cytoplasm and affects the stability and the translation of mRNAs.

Formation of this 3' end occurs in a two step reaction directed by the cleavage/polyadenylation machinery and depends on the presence of two sequence elements in mRNA precursors (pre-mRNAs); a highly conserved hexanucleotide AAUAAA (polyadenylation signal) and a downstream G/U-rich sequence. In a first step, pre-mRNAs are cleaved between these two elements. In a second step, tightly coupled to the first step the newly formed 3' end is extended by addition of a poly(A) sequence consisting of 200-250 adenylates which affects subsequently all aspects of mRNA metabolism, including mRNA export, stability and translation (Dominski and Marzluff, 2007, Gene 396(2): 373-90.). 5' cap structures can also be introduced into in vitro transcribed RNA (Pascolo S., 2006, Methods Mol Med., 127:23-40.).

Typically, the poly(A) tail of a mammalian mRNA contains about 250 adenine nucleotides. It was found that the length of such a poly(A) tail is a potentially critical element for the stability of the individual mRNA. In this context, Holtkamp et al. reported that a poly(A) tail consisting of 120 nucleotides resulted in an increased stability and an increased translation efficiency of the mRNA compared to an mRNA with a shorter poly(A) tail (Holtkamp et al., 2006, Blood, Vol. 108, pp. 4009-4017).

Irrespective of factors influencing mRNA stability, effective translation of the administered nucleic acid molecules by the target cells or tissue is crucial for any approach using nucleic acid molecules for gene therapy or genetic vaccination. Along with the regulation of stability, also translation of the majority of mRNAs is regulated by structural features like UTRs, 5'-cap and 3'-poly(A) tail. In this context, it has been reported that the length of the poly(A) tail may play an important role for translational efficiency as well as having an attenuating effect on translation.

Also 3'-poly(U) tails have been reported to have apparently the same effect of mRNA stability as 3'-poly(A) tails (Horton and Landweber, 2000, Nucleic Acids Research, 28(23):4750-4754). Hence, it can reasonably be expected that also polyuridine (poly(U)), polycytidine (poly(C)) and polyguanosine (poly(G)) tails have the same effect as a poly(A) tail.

As already explained above, RNA is in general a rather unstable molecular species. However, for use of RNA as medicament, in particular in the field of gene therapy, cancer immunotherapy, protein replacement therapy and vaccination, the RNA molecules are desired to be stable and trigger a specific and well defined response in a patient's body. For this purpose and also for regulatory reasons, the RNA molecules need to be homogeneous in particular in view of the length of the polynucleotidyl (poly(N)) tail which has a strong influence on stability and translation of the RNA molecule and thereby on the desired therapeutic effect. Hence, the polynucleotidylation reaction needs to be performed in a well defined and reproducible fashion to specifically control the reaction conditions, in particular the time of the reaction. Moreover, such homogeneous poly(N) RNA molecules need to be produced in large quantities to be available for comprehensive use as medicament. In addition, the production of the RNA molecules should be cost-effective to ensure low-cost medicament provision not only for patients in countries having a well developed health system but also in countries with a comparatively poor public health system correlated with high personal treatment costs.

To date, polynucleotidylation is performed using poly(N) polymerases (PNPs) which are in solution together with all other reaction components, such as RNA and nucleotides. After the polynucleotidylation reaction, the poly(N)RNA is separated and PNP is generally discarded. The state of the art polynucleation reaction thus requires large amounts of PNP and a more advanced purification procedure. However, in order to obtain a homogeneous poly(N)RNA, i.e. RNA molecules having a poly(N) tail of basically the same length, the separation of the reaction partners should be as quick as possible to terminate the reaction after a specific time period. Currently available polyadenylation kits are also not suitable for producing poly(N) RNA molecules in industrial scale. The Poly(A) Tailing Kit of Life Technologies for example is only suitable for very small amounts.

Kerwitz et al. (2003, The EMBO Journal, 22(14): 3705-3714) describe a bovine $His_6$-GST-PAP fusion protein to study the interaction between the poly(A)polymerase and PABPN1 in a GST pull-down experiment. However, the aim of the study was not the production of stable and homogeneous poly(N/A) RNA molecules.

Gershon and Khilko (1995, Journal of Immunological Methods, 183(1):65-76) use the catalytic subunit of a vaccinia virus poly(A) polymerase for chelating linkage for reversible immobilization of oligohistidine tagged proteins in the BIAcore surface plasmon resonance detector. Again, neither a bacterial PNP/PAP was used nor was the enzyme used for production of stable and homogeneous poly(N/A) RNA molecules. An immobilization of the catalytic subunit of a vaccinia virus poly(A) polymerase via covalent binding has neither been described nor suggested. Moreover, the document does not disclose the immobilization of bacterial poly(A)polymerases, nor does it disclose the use of the immobilized poly(A)polymerase for producing polynucleotidylated ribonucleic acid molecules.

M. Prakash (2010, *Enzyme Biotechnology*, Discovery Publishing Pvt. Ltd) describe the binding of anti-poly(A) polymerase antibodies with hepatoma poly(A) polymerase dripped on DBM-paper. Again, the neither a bacterial PNP/PAP was used nor was the enzyme used for production of stable and homogeneous poly(N/A) RNA molecules.

The patent application US 2012/0214171 A1 discloses immobilization of RNA polymerases which are neither structurally nor regarding their biological activity comparable to the claimed immobilized PNP/PAPs. Immobilization is achieved using oligohistidine tags on functionalized solid supports. The document does neither suggest immobilization of RNA polymerases via covalent binding nor as regards benefits of using RNA polymerases of specific biological origin. The document does also neither mention nor suggest immobilization of poly(A/N)polymerases or any benefit of using such enzymes.

Thus, the state of the art PNPs and polynucleotidylation reaction methods do neither straight-forwardly nor cost-effectively produce homogeneous poly(N/A)RNA molecules.

These and other problems are solved by the claimed subject matter, in particular by the employment of an immobilized poly(N/A) polymerase.

SUMMARY OF THE INVENTION

As solution to the above discussed problems, the present invention provides a poly(N)polymerase (PNP) immobilized onto a solid support, a method of producing the PNP and uses thereof. Further provided are an enzyme reactor and a kit comprising the PNP.

The immobilization of the PNP onto a solid support has a number of advantages over classical methods wherein the PNP is free in solution together with the other components of the polynucleotidyl reaction, such as RNA molecules, nucleotides, salts, buffer components etc.

First a PNP which is immobilized onto a solid support may be used repeatedly and for different RNA molecules to be polynuleotidylated which makes the polynucleotidylation reaction much more time-effective (quicker separation), cost-effective and more ecologic since less chemicals and other materials are needed for provision of PNP and its separation from the polynucleotidylated RNA. Immobilization enhanced the stability of the enzyme PNP (e.g. poly(A)polymerase (PAP)) since aggregation and denaturation of the protein are reduced. The reaction can be performed in batch or even fed-batch mode.

Second the immobilization of PNPs facilitates purification of the polynucleotidylated RNA (poly(N) RNA). In fact, the simple removal of the reaction mixture provides for separation of the PNP from the other reaction components and separation steps such as heat denaturation, extraction and precipitation may be avoided. This also reduces impurities (e.g., denatured PNP proteins or fragments) in the produced poly(N) RNA solution.

The immobilization is an important aspect when talking about poly(N) RNA molecules being homogeneous with respect to the length of the poly(N) tail since the length of the poly(N) tail is significantly determined by the molar ratio between RNA and nucleotide provided in the polymerization reaction. Therefore, PNP can be provided in an amount which does not limit the reaction and homogenous poly(N) tails are produced.

Third the saturated immobilization provides for a stable and consistent amount of PNP enzyme which is available in each reaction circle. Thereby the other components of the reaction can be added in excess so that the PNP enzyme works in a saturated fashion which allows for a good control of the length of the poly(N) tail per time unit.

Hence, immobilization of PNP enzymes overcomes a number of drawbacks of state of the art poly(N) RNA production methods.

In the context of the present invention, it is preferred to use a poly(N)polymerase or preferably a poly(A)polymerase which is of bacterial origin. In general, bacterial poly(N/A)polymerases are monomers which may be immobilized more easily, further these bacterial enzymes are generally well characterized.

In the context of the invention, an immobilization strategy via at least one thiol group of said PN/AP enzymes, e.g., allowing for a bond between the PNP enzyme and a solid support which is selected from the group consisting of disulfide bond, thioester bond, and thioether, is preferred. More preferably, the poly(N/A)polymerase is immobilized via a thiol group of at least one cysteine residue and/or via a covalent binding which is a disulfide bridge or a thioether bond. This way of immobilization also avoids the employment of amino groups which are regularly present in the active center of PNP enzymes. Clearly, an immobilization via an amino acid which is present in the active center of a PNP enzyme will severely affect the biological activity of the enzyme. Since cysteine residues are in general not very frequent in amino acid sequence and even less frequently found in the active center of a protein, these residues are preferably chosen for the attachment to the solid support.

Preferably, for immobilization via a thiol group of the PN/AP enzyme, the solid support comprises a reactive group selected from the group consisting of thiol, haloacetyl, pyridyl disulfide, epoxy, maleimide and mixtures thereof; preferably the reactive group is selected from the group consisting of thiol, epoxy, maleimide and mixtures thereof, more preferably the reactive group is selected from the group consisting of thiol, maleimide and mixtures thereof.

Suitable reactive groups to generate thioether linkages comprise epoxy activated supports, maleimide activated supports and haloacetyl activated supports (iodoacetyl, bromoacetyl). In the context of pharmaceutical poly(N/A) RNA production, thiol, maleimide and epoxy supports are preferred.

To further test the immobilization concept, and to facilitate a directed and stable immobilization of a PN/AP enzyme, the inventors generated a mutated bacterial poly(A)polymerase (*Escherichia coli* Poly(A)Polymerase), wherein each natural cysteine residue of the protein has been substituted with an alanine residue, and wherein an N-terminal cysteine has been introduced (attached via a linker element to the N-terminus of the protein). The inventors surprisingly found that said mutated bacterial poly(A)polymerase showed enzymatic activity in solution. In a further experiment, the inventors show that said mutated bacterial poly(A)polymerase immobilized on a solid support via a covalent disulfide bond showed similar enzymatic activity compared to the respective soluble enzyme surprisingly demonstrating that immobilization was well tolerated and did not hinder enzymatic activity of the enzyme. In addition, the inventors surprisingly found that the immobilized bacterial poly(A)polymerase displayed an improved long-term stability and an improved heat-stability. In essence, the inventors show that the immobilization of PNP enzymes is feasible as demonstrated here for the *E. coli* poly(A)polymerase. Therefore, the results demonstrate that immobilization of PNP enzymes is feasible and applicable and shows advantages over soluble enzymes such as improved stability, long-term activity and reusability. This was rather unexpected as one would have expected that immobilization may somehow lead to disturbance of the enzymatic performance of the enzyme. The present invention teaches general rules and strategies to obtain immobilized PN/AP enzymes. These may be used by the skilled person to generate not only immobilized PAPs but also PNPs as well as PNPs of bacterial origin other than *E. coli*. As such it may reasonably be expected that the above results are also transferable to PNPs in general as well as to PNPs of other bacteria as *E. coli* or may be tested for functionality as described herein.

Finally the invention relates to a kit and an enzyme reactor comprising the immobilized PNP. The enzyme reactor provides for the scale-up of the polynucleotidylation reaction in order to provide high yields of homogeneously polynucleotidylated RNA molecules in a reproducible and quick way. Automation of the polynucleotidylation reaction and the separation of the polynucleotidylated RNA together with the renewed utilization of PNP provides thus for an ecologic and economic production of homogeneous poly(N) RNA molecules. The kit is useful for automation and provides a high quality standard due to provision of a controlled and homogeneous reaction environment. In this context, the inventors showed that bacterial poly(A)polymerase immobilized onto a solid support could be re-used for various enzymatic polyadenylation cycles in an enzyme reactor until a desired poly(A)tail length was generated. The present invention also teaches general rules and strategies of poly(A/N) enzyme reactor designs and their application(s).

Hence, the immobilized poly(N/A)polymerase according to the present invention provides for the production of homogeneous and stable polynucleotidylated and polyadenylated RNA molecules, respectively.

Therefore, the present invention provides an immobilized poly(N)polymerase and a poly(N)polymerase characterized in that the poly(N)polymerase is a bacterial poly(N)polymerase and immobilized onto a solid support. Preferably, the poly(N)polymerase is selected from the group consisting of poly(A)polymerase, poly(U)polymerase, poly(G)polymerase and poly(C)polymerase. More preferably, the poly(N)polymerase is a poly(A)polymerase.

The poly(N)polymerase is preferably immobilized onto the solid support by covalent binding, affinity binding, or physical adsorption, more preferably by covalent binding.

In a preferred embodiment of the present invention, the poly(N)polymerase is immobilized by covalent binding to a thiol-activated solid support, haloacetyl functionalized solid support, pyridyl disulfide-functionalized solid support, maleimide-activated solid support or a mixture thereof. Optionally, the poly(N)polymerase is immobilized via a thiol group of at least one cysteine residue.

In a preferred embodiment of the present invention, the poly(N)polymerase is immobilized by covalent binding to a thiol-activated solid support, haloacetyl functionalized solid support, epoxy-functionalized solid support, pyridyl disulfide-functionalized solid support, maleimide-activated solid support or a mixture thereof. Optionally, the poly(N)polymerase is immobilized via a thiol group.

Optionally, the covalent binding is a disulfide bridge or a thioether bond. Optionally, the covalent binding is a disulfide bridge, a thioester bond or a thioether bond.

In another preferred embodiment of the present invention, the solid support comprises a member selected from the group consisting of sepharose, thiopropyl-sepharose, sephadex, agarose, silica, magnetic beads, methacrylate beads, and nanoparticles, preferably the solid support comprises a member selected from the group consisting of sepharose, thiopropyl-sepharose, sephadex, agarose, silica, magnetic beads, and nanoparticles.

More preferably the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, maleimide-activated agarose, epoxy-methacrylate beads, and mixtures thereof, even more preferably the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, maleimide-activated agarose, and mixtures thereof.

In another embodiment, the solid support comprises a member selected from the group consisting of sepharose, thiopropyl-sepharose, sephadex, agarose, silica, magnetic beads, methacrylate beads, and nanoparticles, preferably the solid support comprises a member selected from the group consisting of sepharose, thiopropyl-sepharose, sephadex, agarose, silica, magnetic beads, and nanoparticles.

More preferably, the solid support comprises a reactive group selected from the group consisting of thiol, haloacetyl, pyridyl disulfide, epoxy, maleimide and mixtures thereof, even more preferably the solid support comprises a reactive group selected from the group consisting of thiol, haloacetyl, pyridyl disulfide, maleimide and mixtures thereof.

Preferably, the poly(N)polymerase is derived from *Escherichia coli, Streptomyces coelicolor, Meiothermus silvanus, Bacillus subtilis, Thermus aquaticus, Shigella flexneri, Shigella dysenteriae, Citrobacter koseri, Salmonella bongori, Salmonella enterica, Trabulsiella guamensis, Kluyvera ascorbata, Citrobacter freundii, Enterobacter cloacae, Enterococcus gallinarum, Grimontia indica,* or *Salinivibrio costicola*. Further preferred is that the poly(N)polymerase comprises an amino acid sequence being at least 80% identical to an amino acid sequence as depicted in SEQ ID NO: 1 to 22, and more preferably comprises an amino acid sequence being at least 80% identical to SEQ ID NO: 1, 2 or 3. Most preferably, the PNP comprises an amino acid sequence being at least 80% or 95% identical to SEQ ID NO: 1 to 15. In another highly preferred embodiment, the PNP comprises an amino acid sequence being at least 80% or 95% identical to an amino acid sequence as depicted in any one of SEQ ID NO: 16 to 22.

Even more preferably, the poly(N)polymerase comprises an amino acid sequence being at least 80%, alternatively at least 85%, 87%, 90%, 95%, 97%, 99% or 100% identical to an amino acid sequence as depicted in any one of SEQ ID NOs: 1 to 22 and 24 to 155, preferably comprises an amino acid sequence being at least 80%, alternatively at least 85%, 87%, 90%, 95%, 97%, 99% or 100%, identical to SEQ ID NOs: 1, 2, 3 or 16 to 22, 24 to 155 or 203, more preferably at least 80%, alternatively at least 85%, 87%, 90%, 95%, 97%, 99% or 100%, identical to any one of SEQ ID NOs: 17 to 22, 32 to 83, 85-111, 113-139, 141-145, 146-148, 150-152, 154-155, or 203 even more preferably at least 80%, alternatively at least 85%, 87%, 90%, 95%, 97%, 99% or 100%, identical to any one of SEQ ID Nos: 18, 58-83, 85-111, 113-139 or 203, and most preferably at least 80%%, alternatively at least 85%, 87%, 90%, 95%, 97%, 99% or 100%, identical to SEQ ID NO: 113.

In a preferred embodiment of the present invention, the poly(N)polymerase comprises at least one newly introduced cysteine residue compared to a native poly(N/A)polymerase, preferably the poly(N/A)polymerase comprises an amino acid sequence as depicted in any one of SEQ ID NOs: 17-22, 32-155, or 203, and/or comprises only one cysteine residue or is mutated to comprise only one cysteine residue, preferably the poly(N/A)polymerase comprises an amino acid sequence as depicted in any one of SEQ ID NOs: 2, 16-22, 24-83, 85-111, 113-139, 141-144, 146-148, 150-152, 154-155, or 203.

In a more preferred embodiment, the poly(N)polymerase comprises a linker element as depicted in SEQ ID Nos: 156-180 and/or comprises a purification tag as depicted in SEQ ID NOs: 181-201.

Further provided is a method for producing the poly(N)polymerase, preferably being a poly(A)polymerase, of any one of claims 1 to 14, comprising a step of a) contacting the poly(N)polymerase with a solid support under conditions suitable for immobilizing the poly(N)polymerase to the solid support by covalent binding, affinity binding, or physical adsorption.

Optionally, step a) comprises the formation of a disulfide bridge or thioether bond, preferably, step a) comprises the formation of a covalent bond between a cysteine residue of the poly(N)polymerase and a thiol group, a haloacetyl group, a pyridyl disulfide, an epoxy group, or a maleimide group of the solid support, more preferably step a) comprises the formation of a covalent bond between a cysteine residue of the poly(N)polymerase and a thiol group, a haloacetyl group, a pyridyl disulfide or a maleimide group of the solid support. In an optional embodiment, the solid support is a thiol-activated solid support, haloacetyl functionalized solid support, pyridyl disulfide-functionalized solid support, epoxy activated solid support, or maleimide-activated solid support, preferably the solid support is a thiol-activated solid support, haloacetyl functionalized solid support, pyridyl disulfide-functionalized solid support, or maleimide-activated solid support.

In one embodiment of the present invention, the method further comprises prior to step a) a step of b) expressing the poly(N)polymerase in a suitable expression host.

In an additional embodiment of the present invention, the method further comprises prior to step a) and, if present, after step b) a step of c) purifying the poly(N)polymerase from an expression host.

Preferably, step c) comprises purifying the poly(N)polymerase via affinity chromatography, preferably, the poly(N)polymerase comprises an affinity tag as depicted in any one of SEQ ID NOs: 181-201.

Preferably, the poly(N)polymerase is a bacterial poly(N)polymerase, more preferably, the poly(N)polymerase is selected from the group consisting of poly(A)polymerase, poly(U)polymerase, poly(G)polymerase and poly(C)polymerase, even more preferably the poly(N)polymerase is a poly(A)polymerase.

Also provided is a use of a poly(N)polymerase, preferably being a poly(A)polymerase, being immobilized onto a solid support for producing polynucleotidylated ribonucleic acid (poly(N)RNA) molecules, preferably polyadenylated ribonucleic acid (poly(A)RNA) molecules. Preferably, used is the poly(N)polymerase as defined above. Particularly preferred is the use of a poly(A)polymerase, optionally of a poly(A)polymerase of bacterial origin, more preferably of a poly(A)polymerase as defined herein or as defined in the claims.

In a preferred embodiment of the present invention the use comprises a step of i) contacting the poly(N)polymerase with RNA molecules and nucleotides under conditions suitable for forming a covalent bond between the nucleotides and the RNA molecules. Optionally, the RNA is messengerRNA (mRNA).

The nucleotides may be selected from the group consisting of adenosine triphosphate (ATP), cytidine triphosphate (CTP), uridine triphosphate (UTP), guanosine triphosphate (GTP), nucleotide analogs and mixtures thereof.

In one embodiment of the present invention, step i) is performed for at least 5 min or is performed for at least 10 to 120 min or is performed for 180 minutes or longer.

In a preferred embodiment of the present invention, in step i) 0.5 to 2 mol RNA are present; and/or wherein in step i) 50 to 500 mol nucleotides are present, preferably the nucleotides are ATP.

Further comprised may be a step of ii) isolating the poly(N)RNA molecules, optionally by filtration or chromatography, preferably filtration comprises ultrafiltration and/or diafiltration.

In a preferred embodiment of the present invention the poly(N)RNA molecules produced by using the PNP or PAP of the present invention are essentially homogenous or at least 80% of the poly(N)RNA molecules are of the same length.

Preferably, each of the poly(N)RNA molecules comprises at least 120 nucleotidylates, preferably at least 120 adenylates.

In one optional embodiment of the present invention the produced poly(N)RNA molecules are for use in gene therapy, immunotherapy, protein replacement therapy and/or vaccination.

In one embodiment of the present invention, the nucleotides are ATP and the poly(N)RNA molecules are poly(adenylated)RNA (poly(N)RNA) molecules.

Further provided is an enzyme reactor comprising a poly(N)polymerase being immobilized onto a solid support or comprising a poly(N)polymerase as described herein or comprising a poly(N)polymerase obtainable by the method described herein. Preferably, the poly(N)polymerase is a poly(A)polymerase.

Optionally, the enzyme further comprises
a) at least one reaction vessel, also denoted as reaction module (11), comprising the immobilized poly(N)polymerase,
b) one or more devices for measuring and/or adjusting at least one parameter selected from the group consisting of pH, salt concentration, magnesium concentration, phosphate concentration, temperature, pressure, flow velocity, RNA concentration and nucleotide concentration.

In a preferred embodiment, the enzyme reactor further comprises
c) a capture module (13);
d) a feed module (14); and/or
e) an in vitro transcription (IVT) module (16), preferably, the IVT module is for RNA in vitro transcription.

Optionally, the IVT module (16) and/or the feed module (14) comprise a device for adjusting and controlling the temperature (12).

The enzyme reactor may further comprise
f) at least one sensor unit (15), optionally at least one sensor unit (15) being present at the reaction module (11), the capture module (13) and/or the feed modules (14 and 16). Optionally, the at least one sensor unit comprises at least one ion-selective electrode, preferably being sensitive towards $H^+$, $Na^+$, $K^+$, $Mg^{2+}$, $Ca^{2+}$, $Cl^-$ and/or $PO_4^{3-}$.

Optionally, the reaction module (11) further comprises a filtration membrane (6), preferably being an ultrafiltration membrane, more preferably the filtration membrane (6) or the ultrafiltration membrane has a molecular weight cut-off in a range from 10 kDa to 500 MDa, preferably in a range from 50 kDa to 300 MDa, more preferably from 100 kDa to 100 MDa, even more preferably from 500 kDa to 50 MDa, and most preferably from 750 kDa to 25 MDa, such as 1 MDa.

In a preferred embodiment, the capture module (13) comprises a resin to capture the produced poly(N)RNA molecules and to separate the produced nucleic acid molecules from other soluble components of the reaction mix. More preferably, the capture module (13) comprises a sensor unit (15).

In an even more preferred embodiment, reaction module (11) further comprises a reflux module (19).

In one embodiment, the enzyme reactor comprises more than one reaction module (11).

Preferably, the reaction vessel comprises a thiol-activated solid support, haloacetyl functionalized solid support, pyridyl disulfide-functionalized solid support, epoxy-activated solid support, or maleimide-activated solid support, more preferably the reaction vessel comprises a thiol-activated solid support, haloacetyl functionalized solid support, pyridyl disulfide-functionalized solid support or maleimide-activated solid support; even more preferably the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, epoxy-methacrylate beads, and maleimide-activated agarose, most preferably, the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, and maleimide-activated agarose.

In another preferred embodiment of the present invention, the enzyme reactor is suitable for the use as described herein.

Further provided is a kit comprising a poly(N)polymerase characterized in that the poly(N)polymerase is immobilized onto a solid support, preferably the poly(N)polymerase as further defined herein, such as a poly(N)polymerase or poly(A)polymerase of bacterial origin, or producible by the method described herein, a poly(N)polymerase reaction buffer, and nucleoside monophosphates, optionally a nucleotide mixture, further optionally an RNA polymerase, and optionally an RNA in vitro transcription buffer. Preferably, the poly(N)polymerase is a poly(A)polymerase.

Soluble PAP mut2 and immobilized PAP-TS mut2 proteins were pre-incubated at 37° C. for 10, 30, 90 and 180 minutes. Then, poly(A)polymerase tailing assay was performed to assess polyadenylation activity. (A) shows the result for the soluble mut2 protein. (B) shows the result for the immobilized PAP-TS mut2 protein. Lane 1: 10 min pre-incubation at 37° C.; lane 2: 30 min pre-incubation at 37° C.; lane 3: 90 min pre-incubation at 37° C.; lane 4: 180 min pre-incubation at 37° C. The horizontal bar in lanes 1 and 2 highlights the difference in activity after heat stress, showing that the immobilized PAP-TS mut2 has improved heat stability. A detailed description of the experiment is provided in Example 3. nt=number of nucleotides.

Figure 9:
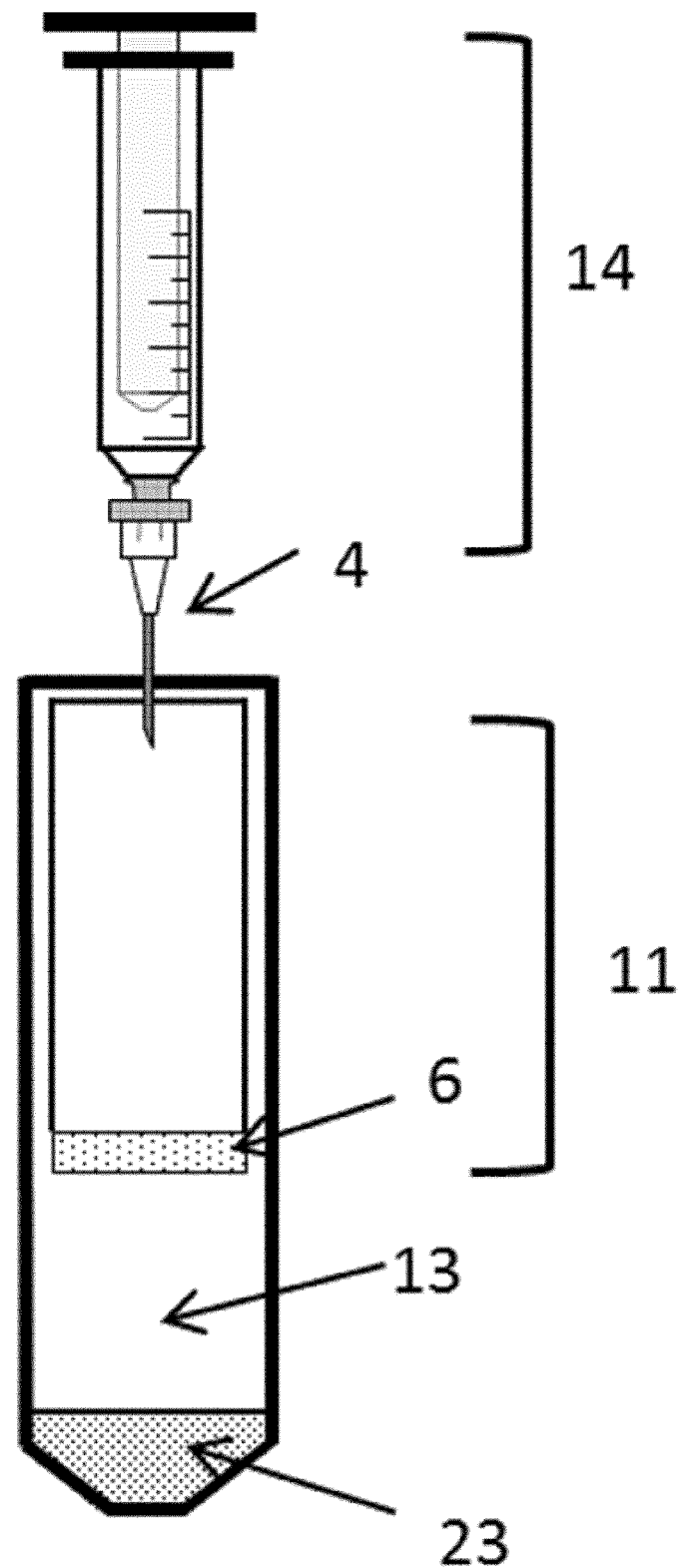

FIG. 9: Small-scale enzyme reactor which consists of an inlet comprising an injection device (4) and a reaction module (11) comprising a filtration unit (6) and a capture module (13). The produced poly(N/A) RNA (23) can be collected after centrifugation in the capture module (13). A detailed description of the experiment is provided in Example 4.

Figure 10:
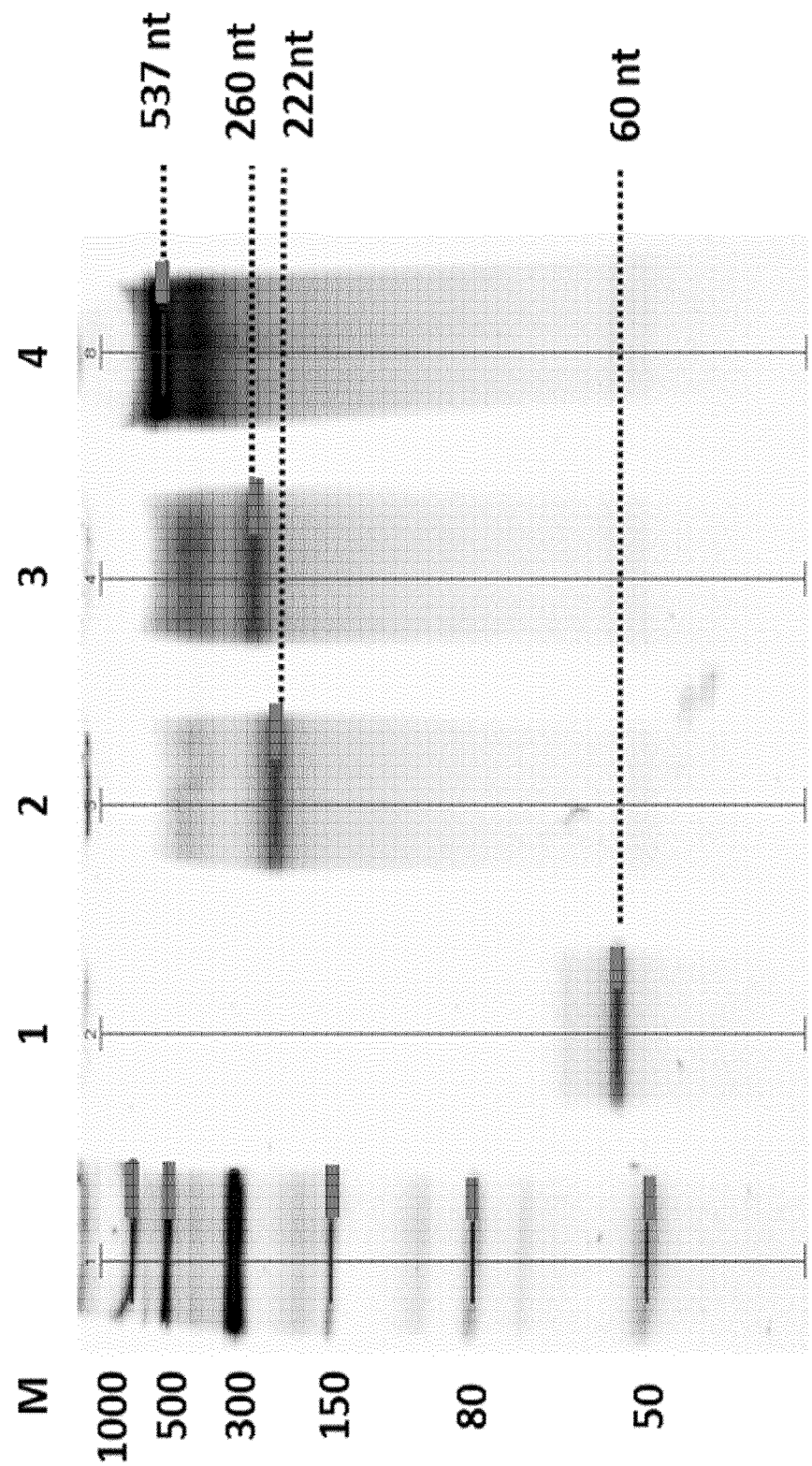

FIG. 10: Reusability of immobilized PAP-TS mut2 beads in the polyadenylation reactor. In an enzyme reactor (such as in FIG. 9), the PAP-TS mut2 beads were reused for several reaction cycles. The elongation of the poly(A)tail over time shows that the inventive immobilized PAP-TS mut2 beads can be reused for several reaction cycles. The respective band sizes of the RNA are indicated. Lane 1: reaction start; lane 2: one cycle for 10 minutes; lane 3: two reaction cycles, 10 minutes each; lane 4: 6 reaction cycles, 10 minutes each. M: number of nucleotides, indicated by the marker lane. A detailed description of the experiment is provided in Example 4.

Figure 11:
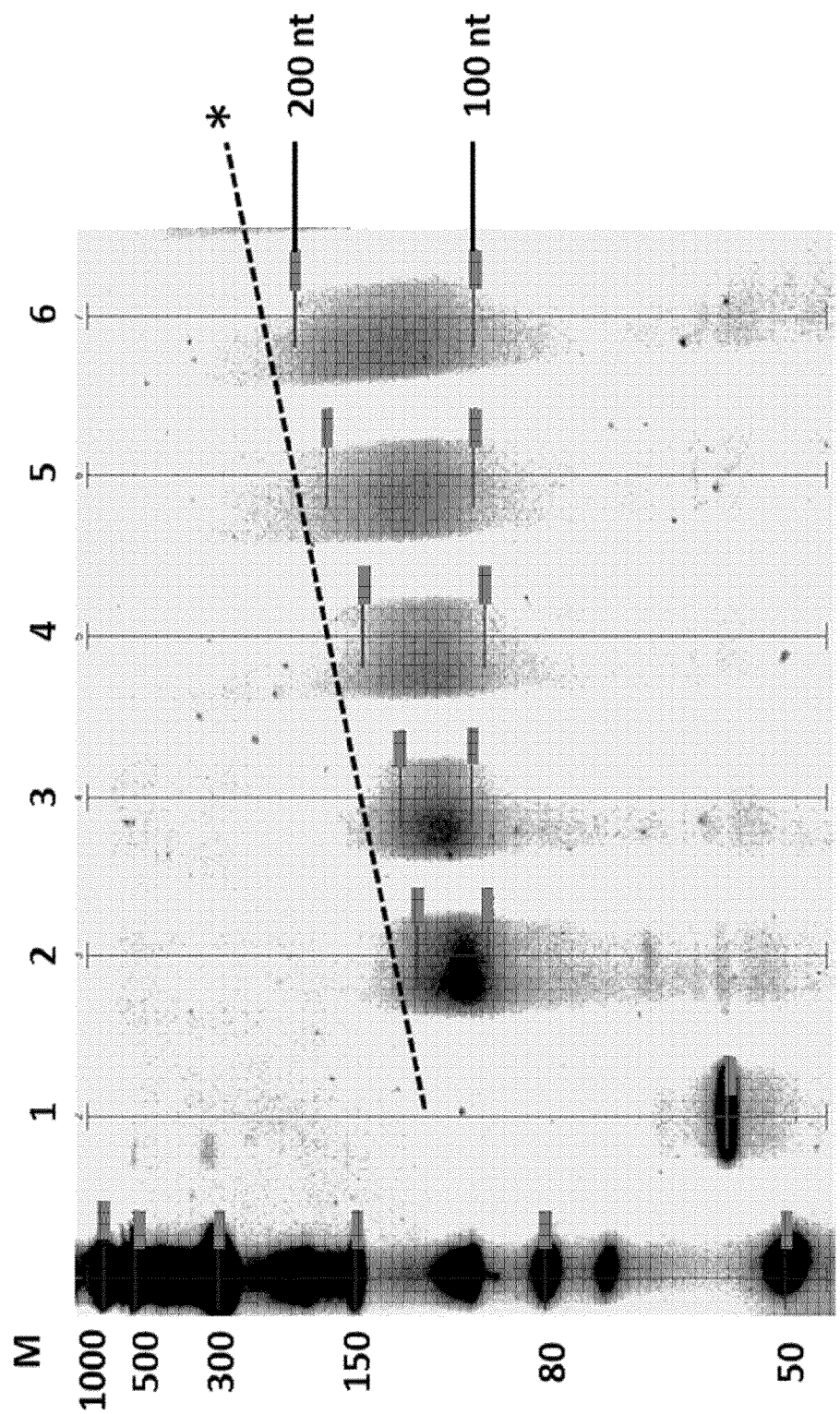

FIG. 11: Use of an enzyme reactor of the invention to generate poly(A)RNA molecules with a defined poly(A)tail length. In an enzyme reactor, such as in FIG. 9, the PAP-TS mut2 beads were reused for several reaction cycles. A defined amount of 50 μM ATP was injected in 10 min time intervals until the desired poly(A) tail length of 200 adenosines was obtained. Lane 1: reaction start, the band at 60 nucleotides (nt) shows the RNA template; lane 2: reaction progress 10 min after initiation; lane 3: reaction progress 10 min after ATP feed-in; lane 4: reaction progress 10 min after an additional ATP feed-in; lane 5: reaction progress 10 min after an additional ATP feed-in; lane 6: reaction progress 10 min after an additional ATP feed-in; the dashed line (indicated by an asterisk) shows that via the ATP feeds, a nucleotides, indicated by the marker lane. A detailed description of the experiment is provided in Example 4.

DEFINITIONS

For the sake of clarity and readability, the following definitions are provided. Any technical feature mentioned for these definitions may be read on each and every embodiment of the invention. Additional definitions and explanations may be specifically provided in the context of these embodiments. Unless defined otherwise, all technical and scientific terms used herein generally have the same meaning as commonly understood by one of ordinary skill in the art to which this invention belongs. Generally, the nomenclature used herein and the laboratory procedures in cell culture, molecular genetics, organic chemistry, and nucleic acid chemistry and hybridization are those well known and commonly employed in the art. Standard techniques are used for nucleic acid and peptide synthesis. The techniques and procedures are generally performed according to conventional methods in the art and various general references (e.g., Sambrook et al., 1989, Molecular Cloning: A Laboratory Manual, 2d ed. Cold Spring Harbor Laboratory Press, Cold Spring Harbor, N.Y.), which are provided throughout this document.

Enzyme: Enzymes are catalytically active biomolecules that perform biochemical reactions such as DNA dependent RNA transcription (e.g., RNA polymerases), or double stranded DNA digestion (e.g., restriction endonucleases). Enzymes are typically composed of amino acids and/or RNA (ribozymes, snRNA). The poly(N)polymerase and more specifically poly(A)polymerase of the invention are enzymes.

Protein: A protein typically comprises one or more peptides or polypeptides. A protein is typically folded into a 3-dimensional form, which may be required for the protein to exert its biological function. The sequence of a protein or peptide is typically understood to be the order, i.e. the succession of its amino acids.

Recombinant protein: The term 'recombinant protein' refers to proteins produced in a heterologous system, that is, in an organism that naturally does not produce such a protein, or a variant of such a protein. In case, a protein is expressed from a typical expression vector in an expression host which also naturally expresses this protein—however—not in such increased quantities, such protein is also to be understood as "recombinant protein". Said recombinant protein may also comprise elements necessary for the purification of the protein, e.g. purification tags, e.g. oligo histidine tags (HIS-tags). Examples of purification tags are given in SEQ ID NOs: 181-201. Typically, the heterologous systems used in the art to produce recombinant proteins are bacteria (e.g., *Escherichia* (*E.*) *coli*), yeast (e.g., *Saccharomyces* (*S.*) *cerevisiae*) or certain mammalian cell culture lines.

Expression host: An expression host denotes an organism which is used for recombinant protein production. General expression hosts are bacteria, such as *E. coli*, yeasts, such as *Saccharomyces cerevisiae* or *Pichia pastoris*, or also mammal cells, such as human cells.

Poly(N)polymerase (PNP): Another expression is polynucleotidyl polymerase. PNPs catalyze the covalent attachment of nucleotide residues to the 3'-end of RNA, in particular mRNA, thereby forming a poly(N) sequence. The PNP may be a poly(A) polymerase, poly(U)polymerase, poly(C)polymerase or poly(G)polymerase. In general, these polymerases have preference for a specific nucleotide, however, may also use other nucleotides if available, e.g. poly (U) polymerases having activity for ATP, UTP and GTP (Lunde et al., 2012, *Nucleic acids research* 40.19:9815-9824). Wherever herein the term poly(N)polymerase or PNP is used, this term is to be understood to comprise as a preferred embodiment a poly(N)polymerase or PNP of bacterial origin. Further, wherever herein the term poly(N) polymerase or PNP is used, this term is to be understood to comprise as a very preferred embodiment a poly(A)polymerase or PAP, more preferably a bacterial poly(A)polymerase or bacterial PAP. Hence, all embodiments which are described herein elsewhere to refer to poly(N)polymerase or PNP are meant to refer to poly(A)polymerase or PAP as well, in particular are meant to refer to a poly(A)polymerase or PAP of bacterial origin. This connection is often expressed by the terms "poly(N/A)polymerase" or "PN/AP".

Poly(A)polymerase (PAP): Catalyzes the covalent attachment of adenosine to the 3'-end of RNA, in particular mRNA. Other expressions for PAP are (Polynucleotide) adenylyltransferase, poly A polymerase, polyadenylate synthetase, ATP-RNA adenylyltransferase, and polyadenylate polymerase, these terms may be used interchangeably. The poly(A)polymerase of the present invention has preference for ATP and transfers the attachment of adenosine monophosphates to the 3'-end of RNA, particularly mRNA. If at least one adenosine monophosphate is already attached to the RNA, the next adenosine monophosphate is attached thereto, forming a poly(A) sequence. The term "poly(N/A) polymerase" or the abbreviation "PNP/PAP" is used to denote poly(N)polymerase as well as poly(A)polymerase. The same principle applies to poly(N/A)tail or poly(N/A) sequence and others.

Poly(N) sequence: A poly(N) sequence, also called poly (N) tail or 3'-poly(N) tail, is usually understood to be a sequence of nucleotides, e.g., of up to about 400 nucleotides, e.g. from about 20 to about 400, preferably from about 50 to about 400, more preferably from about 50 to about 300, even more preferably from about 50 to about 250, most preferably from about 60 to about 250 nucleotides, which is preferably added to the 3'-terminus of an RNA, in particular mRNA. A poly(N) sequence is typically located at the 3'-end of an (m)RNA. In the context of the present invention, a poly(N) sequence may be located within an (m)RNA or any other nucleic acid molecule, such as, e.g., in a vector, for example, in a vector serving as template for the generation of an RNA, preferably an mRNA, e.g., by transcription of the vector. In the context of the present invention, the term 'poly(A) sequence' further comprises also sequence elements, preferably artificial sequence elements, that are part of the 3'-UTR or located at the 3'-terminus of the artificial nucleic acid molecule, and which preferably comprise up to 1100 nucleotides, more preferably at least 60, 70, 80, 90, 100, 110, 120, 130, 140, 150, 160, 170, 180, 190, 200, 210, 220, 230, 240, 250, 300, 350, 400, 500, 600, 700, 800, 900, or at least 1000 nucleotides. The nucleotides may be adenosine, cytidine, uridine, guanosine, modified nucleotides, nucleotide analogs and mixtures thereof. Hence, the poly(N) sequence may comprise different nucleotides, i.e. be a heteropolymeric sequence.

Poly(A) sequence: A poly(A) sequence, also called poly (A) tail or 3'-poly(A) tail, is usually understood to be a sequence of adenine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides, which is preferably added to the 3'-terminus of an mRNA. A poly(A) sequence is typically located at the 3'-end of an RNA, in particular mRNA. In the context of the present invention, a poly(A) sequence may be located within an (m)RNA or any other nucleic acid molecule, such as, e.g., in a vector, for example, in a vector serving as template for the generation of an RNA, preferably an mRNA, e.g., by transcription of the vector. In the context of the present invention, the term 'poly(A) sequence' further comprises also sequence elements, preferably artificial sequence elements, that are part of the 3'-UTR or located at the 3'-terminus of the artificial nucleic acid molecule, and which preferably comprise up to 1100 adenine nucleotides, more preferably at least 60, 70, 80, 90, 100, 110, 120, 130, 140, 150, 160, 170, 180, 190, 200, 210, 220, 230, 240, 250, 300, 350, 400, 500, 600, 700, 800, 900, or at least 1000 adenine nucleotides. In general, the poly(A) sequence consists of adenosine monophosphates.

Polynucleotidylation: Polynucleotidylation is typically understood to be the addition of a poly(N) sequence to a nucleic acid molecule, such as an RNA molecule. As used in the context of the present invention, the term may relate to polynucleotidylation of RNA as a cellular process as well as to polynucleotidylation carried out by enzymatic reaction in vitro or by chemical synthesis.

Polyadenylation: Polyadenylation is typically understood to be the addition of a poly(A) sequence, i.e. a sequence of adenosine monophosphate, to a nucleic acid molecule, such as an RNA molecule. As used in the context of the present invention, the term may relate to polyadenylation of RNA as a cellular process as well as to polyadenylation carried out by enzymatic reaction in vitro or by chemical synthesis.

RNA, mRNA: RNA is the usual abbreviation for ribonucleic acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA sequence. Usually, RNA may be obtainable by transcription of a DNA sequence, e.g., inside a cell. In eukaryotic cells, transcription is typically performed inside the nucleus or the mitochondria. In vivo, transcription of DNA usually results in the so-called premature RNA, which has to be processed into so-called messenger RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino acid sequence of a particular peptide or protein. Typically, a mature mRNA comprises a 5'-cap, a 5'-UTR, an open reading frame, a 3'-UTR and a poly(A) sequence. Aside from messenger RNA, several non-coding types of RNA exist, which may be involved in the regulation of transcription and/or translation. and immunostimulation and which may also be produced by in vitro transcription.

Short RNA molecules can also be synthesized by chemical methods whereas long RNAs are typically produced by in vitro transcription reactions containing a suitable DNA template with a bacteriophage-derived promoter, an RNA polymerase, for example bacteriophage SP6, T3 or T7 RNA polymerase and ribonucleoside triphosphates (NTPs).

DNA: DNA is the usual abbreviation for deoxyribonucleic acid. It is a nucleic acid molecule, i.e. a polymer consisting of nucleotide monomers. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerized by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA-sequence. DNA may be single-stranded or double-stranded. In the double stranded form, the nucleotides of the first strand typically hybridize with the nucleotides of the second strand, e.g. by A/T-base-pairing and G/C-base-pairing.

Sequence of a nucleic acid molecule/nucleic acid sequence: The sequence of a nucleic acid molecule is typically understood to be the particular and individual order, i.e. the succession of its nucleotides.

Sequence of amino acid molecules/amino acid sequence: The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent, to which two sequences are identical, i.e. it typically describes the percentage of nucleotides that correspond in their sequence position to identical nucleotides of a reference sequence. For the determination of the degree of identity, the sequences to be compared are considered to exhibit the same length, i.e. the length of the longest sequence of the sequences to be compared. This means that a first sequence consisting of 8 nucleotides/amino acids is 80% identical to a second sequence consisting of 10 nucleotides/amino acids comprising the first sequence. In other words, in the context of the present invention, identity of sequences preferably relates to the percentage of nucleotides/amino acids of a sequence, which have the same position in two or more sequences having the same length. Gaps are usually regarded as non-identical positions, irrespective of their actual position in an alignment.

The sequence identity may be determined using a series of programs, which are based on various algorithms, such as BLASTN, ScanProsite, the laser gene software, etc. As an alternative, the BLAST program package of the National Center for Biotechnology Information may be used with the default parameters. In addition, the program Sequencher (Gene Codes Corp., Ann Arbor, Mich., USA) using the "dirtydata"-algorithm for sequence comparisons may be employed.

The identity between two protein or nucleic acid sequences is defined as the identity calculated with the program needle in the version available in April 2011. Needle is part of the freely available program package EMBOSS, which can be downloaded from the corresponding website. The standard parameters used are gapopen 10.0 ("gap open penalty"), gapextend 0.5 ("gap extension penalty"), datafile EONAFULL (matrix) in the case of nucleic acids.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the open reading frame and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

3'-untranslated region (3'-UTR): Generally, the term "3'-UTR" refers to a part of the artificial nucleic acid molecule, which is located 3' (i.e. "downstream") of an open reading frame and which is not translated into protein. Typically, a 3'-UTR is the part of an mRNA, which is located between the protein coding region (open reading frame (ORF) or coding sequence (CDS)) and the poly(N/A) sequence of the (m)RNA. In the context of the invention, a 3'-UTR of the artificial nucleic acid molecule may comprise more than one 3'-UTR elements, which may be of different origin, such as sequence elements derived from the 3'-UTR of several (unrelated) naturally occurring genes. Accordingly, the term 3'-UTR may also comprise elements, which are not encoded in the template, from which an RNA is transcribed, but which are added after transcription during maturation, e.g. a poly(N/A) sequence. A 3'-UTR of the mRNA is not translated into an amino acid sequence. The 3'-UTR sequence is generally encoded by the gene, which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5' capping, splicing the pre-mature mRNA to excize optional introns and modifications of the 3'-end, such as polynucleotidylation/polyadenylation of the 3'-end of the pre-mature mRNA and optional endo-/or exonuclease cleavages etc. In the context of the present invention, a 3'-UTR corresponds to the sequence of a mature mRNA which is located between the stop codon of the protein coding region, preferably immediately 3' to the stop codon of the protein coding region, and the poly(N/A) sequence of the mRNA. The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR. As used herein, the term "3'-UTR element" typically refers to a fragment of a 3'-UTR as defined herein. In particular, the term comprises any nucleic acid sequence element, which is located 3' to the ORF in the artificial nucleic acid molecule, preferably the mRNA, according to the invention. Accordingly, the term covers, for example, sequence elements derived from the 3'-UTR of a heterologous gene as well as elements such as a poly(C) sequence or a histone stem-loop.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, which are also called regulatory elements. Such regulatory elements may be, for example, ribosomal binding sites. The 5'-UTR may be posttranscriptionally modified, for example by addition of a 5'-cap. In the context of the present invention, a 5'-UTR corresponds to the sequence of a mature mRNA, which is located between the 5'-cap and the start codon. Preferably, the 5'-UTR corresponds to the sequence, which extends from a nucleotide located 3' to the 5'-cap, preferably from the nucleotide located immediately 3' to the 5'-cap, to a nucleotide located 5' to the start codon of the protein coding region, preferably to the nucleotide located immediately 5' to the start codon of the protein coding region. The nucleotide located immediately 3' to the 5'-CAP of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR.

Nucleotide analog/Modified nucleotide/Modified nucleoside triphosphate: The terms "nucleotide analog" or "modified nucleotide" denote a nucleotide which is still substrate of a poly(N)polymerase or poly(A)polymerase and can thus be attached to an RNA molecule to form a tail structure, i.e. a sequence of nucleotides/nucleotide analogs, but is chemically amended and differs from the four standard nucleotides adenosine, cytidine, uridine and guanosine. The term also includes synthetic nucleotide analogs and nucleotide analogs which lead to a termination of the polynucleotidylation/polyadenylation reaction and/or which hinder the action of exonucleases thereby stabilizing the poly(N) tail and thus the poly(N)RNA molecule. Furthermore the nucleotide analogs may also be comprised in the RNA molecule itself outside of the poly(N) tail.

The term "modified nucleoside triphosphate" as used herein refers to chemical modifications comprising backbone modifications as well as sugar modifications or base modifications. These modified nucleoside triphosphates are also termed herein as (nucleotide) analogs, modified nucleosides/nucleotides or nucleotide/nucleoside modifications.

5'-cap: A "5'-cap" is an entity, typically a modified nucleotide entity, which generally "caps" the 5'-end of a mature mRNA. A 5'-cap may typically be formed by a modified nucleotide (cap analog, e.g., m7G(5')ppp(5')G (m7G)), particularly by a derivative of a guanine nucleotide. Preferably, the 5'-cap is linked to the 5'-terminus of a nucleic acid molecule, preferably an RNA, via a 5'-5'-triphosphate linkage. A 5'-cap may be methylated, e.g. m7GpppN (e.g. m7G(5')ppp(5')G (m7G)), wherein N is the terminal 5' nucleotide of the nucleic acid carrying the 5'-cap, typically the 5'-end of an RNA. Such a 5'-cap structure is called cap0. In vivo, capping reactions are catalyzed by capping enzymes. In vitro, a 5'-cap may be formed by a modified nucleotide, particularly by a derivative of a guanine nucleotide. Preferably, the 5'-cap is linked to the 5'-terminus via a 5'-5'-triphosphate linkage.

A 5'-cap may be methylated, e.g. m7GpppN, wherein N is the terminal 5' nucleotide of the nucleic acid carrying the 5'-cap, typically the 5'-end of an RNA. m7GpppN is the 5'-cap structure which naturally occurs in mRNA, typically referred to as cap0 structure.

Enzymes, such as cap-specific nucleoside 2'-O-methyl-transferase enzyme create a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl. Such a structure is called the cap1 structure.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5-dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. Further modified 5'-cap structures which may be used in the context of the present invention are cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse CAP analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

Purification: As used herein, the term "purification" or "purifying" is understood to mean that the desired nucleic acid in a sample is separated and/or isolated from impurities, intermediates, byproducts and/or reaction components present therein or that the impurities, intermediates, byproducts and/or reaction components are at least depleted from the sample comprising the nucleic acid. Non-limiting examples of undesired constituents of RNA-containing samples which therefore need to be depleted may comprise degraded fragments or fragments which have arisen as a result of premature termination of transcription, or also excessively long transcripts if plasmids are not completely linearized. Furthermore, intermediates may be depleted from the sample such as e.g. template DNA. Additionally, reaction components such as enzymes, proteins, bacterial DNA and RNA, small molecules such as spermidine, buffer components etc. may have to be depleted from the RNA sample. An example of a protein impurity present in a sample may be Poly(A) polymerase enzyme. In addition, impurities such as, organic solvents, and nucleotides or other small molecules may be separated. One possibility is the purification via affinity chromatography as well known to the skilled person in the art. Suitable purification or affinity tags are given in SEQ ID NOs: 181-201.

Immobilization: The term "immobilization" relates to the attachment of a molecule, in particular the poly(N)polymerase or poly(A)polymerase of the present invention, to an inert, insoluble material which is also called solid support.

Enzyme reactor: An "enzyme reactor", also called "polyadenylation reactor", may be any enzyme reactor comprising a vessel suitable for comprising the poly(N)polymerase or preferably poly(A)polymerase of the present invention immobilized onto a solid support. The enzyme reactor is further suitable for comprising the other components of the polynucleotidylation/polyadenylation reaction, such as nucleotides, in particular adenosine triphosphate (ATP), and RNA molecules, as well as water, buffer components and salts and is suitable for performing the polynucleotidylation/ polyadenylation reaction. That means the enzyme reactor is suitable so that the operator can apply the desired reaction conditions, e.g., temperature, reaction component concentration, salt and buffer concentration, pressure and pH value. The enzyme reactor further allows for the introduction and removal of the reaction components.

Reaction components: "Reaction components" or "components of the polynucleotidylation/adenylation reaction" denote the components of the polynucleotidylation/polyadenylation reaction, i.e. immobilized poly(N)polymerase or poly(A)polymerase, respectively, nucleotides or ATP, respectively, and RNA. Additional components are water, buffer components and salts. In the course of the reaction, poly(N/A) RNA molecules emerge which are also considered to be reaction components.

Newly introduced amino acids: "Newly introduced amino acids" denote amino acids which are newly introduced into an amino acid sequence in comparison to a native amino acid sequence. Usually by mutagenesis, the native amino acid sequence is changed in order to have a certain amino acid side chain at a desired position within the amino acid sequence. In the present invention, in particular the amino acid cysteine is newly introduced into the amino acid sequence at one or more desired positions since the side chain of cysteine being a thiol group allows for easy and straightforward immobilization of the poly(N/A)polymerase onto a solid support via formation of a disulfide bridge or thioether bond, depending on the functional group of the solid support.

Functional group: The term is to be understood according to the skilled person's general understanding in the art and denotes a chemical moiety which is present on a molecule, in particular on the solid support, and which may participate in a covalent or non-covalent bond to another chemical molecule, such as of a poly(N/A)polymerase. Exemplary functional groups in the context of the invention are thiol, haloacetyl, pyridyl disulfide, epoxy and a maleimide group.

Native amino acid sequence: The term is to be understood according to the skilled person's general understanding in the art and denotes the amino acid sequence in the form of its occurrence in nature without any mutation or amino acid amendment by man. Also called "wild-type sequence". "Native poly(N/A)polymerase" denotes a poly(N/A)polymerase having the amino acid sequence as it occurs in nature. The presence or absence of an N-terminal methionine, which depends on the expression host used, usually does not change the status of a protein being considered as having its natural or native sequence.

Mutated, mutant: The term is to be understood according to the skilled person's general understanding in the art. An amino acid sequence is called "mutated" if it contains at least one additional, deleted or exchanged amino acid in its amino acid sequence in comparison to its natural or native amino acid sequence, i.e. if it contains an amino acid mutation. Mutated proteins are also called mutants. "Mutated to comprise only one cysteine residue" denotes that the amino acid sequence has been changed on the amino acid level so that the amino acid sequence contains only one cysteine residue. This may include that a cysteine residue was introduced via site-directed mutagenesis or one or more cysteine residues were removed, leaving only one cysteine residue in the amino acid sequence. The term "mutant" is generally understood as a protein that differs from its corresponding wild-type sequence in at least one amino acid. The term "mutant" is also used herein if wild type proteins are C-terminally or N-terminally extended. In the context of the invention, PAP proteins derived from *Escherichia coli* according to e.g. SEQ ID NOs: 16-18, 24-140, or 203 are considered as mutant *E. coli* PAP proteins.

Homogeneous: "Homogeneous" or "essentially homogeneous" in the context of polynucleotidylated/polyadenylated RNA molecules denotes that the RNA molecules comprise an poly(N/A) tail of essentially the same length. "Essentially the same length" denotes that at least 80%, at least 90% or at least 95% of the RNA molecules comprise a poly(N/A) tail having the same number of nucleotides/adenosine residues.

Gene therapy: Gene therapy may typically be understood to mean a treatment of a patient's body or isolated elements of a patient's body, for example isolated tissues/cells, by nucleic acids encoding a peptide or protein. It may typically comprise at least one of the steps of a) administration of a nucleic acid, preferably an artificial nucleic acid molecule as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient.

(Genetic) vaccination: "Genetic vaccination" or "vaccination" may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells, either in vivo or in vitro; b) transcription and/or translation of the introduced nucleic acid molecule; and optionally c) re-administration of isolated, transfected cells to the subject, preferably the patient, if the nucleic acid has not been administered directly to the patient.

Immunotherapy: The term "immunotherapy" is to be understood according to the general understanding of the skilled person in the fields of medicine and therapy. Also used in this context are the terms "biologic therapy" or "biotherapy". It is the treatment of a disease by inducing, enhancing, or suppressing an immune response in a patient's body and comprises in particular cancer immunotherapy. Immunotherapy is also being applied in many other disease areas, including allergy, rheumatoid disease, autoimmunity and transplantation, as well as in many infections, such as HIV/AIDS and hepatitis.

Protein replacement therapy: The term "protein replacement therapy" is to be understood according to the general understanding of the skilled person in the fields of medicine and therapy and denotes, in its broadest sense, that a protein which is absent in a patient or not available in the necessary amount is provided to the patient or "replaced". In general, this is done by administering to the patient an intravenous infusion containing the enzyme. Enzyme replacement therapy is e.g. available for lysosomal diseases, such as Gaucher disease, Fabry disease, MPS I, MPS II (Hunter syndrome), MPS VI and Glycogen storage disease type II.

Enzyme replacement therapy does not affect the underlying genetic defect, but increases the concentration of the deficient enzyme.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Half-life: The term "half-life", as used herein in the context of administering a poly(N/A) RNA to a patient, is defined as the time required for plasma concentration of a drug in a patient to be reduced by one half. There may be more than one half-life associated with the poly(N/A) RNA depending on multiple clearance mechanisms, redistribution, and other mechanisms well known in the art. Usually, alpha and beta half-lives are defined such that the alpha phase is associated with redistribution, and the beta phase is associated with clearance.

Chemical synthesis of RNA: Chemical synthesis of relatively short fragments of oligonucleotides with defined chemical structure provides a rapid and inexpensive access to custom-made oligonucleotides of any desired sequence. Whereas enzymes synthesize DNA and RNA only in the 5' to 3' direction, chemical oligonucleotide synthesis does not have this limitation, although it is most often carried out in the opposite, i.e. the 3' to 5' direction. Currently, the process is implemented as solid-phase synthesis using the phosphoramidite method and phosphoramidite building blocks derived from protected nucleosides (A, C, G, and U), or chemically modified nucleosides.

To obtain the desired oligonucleotide, the building blocks are sequentially coupled to the growing oligonucleotide chain on a solid phase in the order required by the sequence of the product in a fully automated process. Upon the completion of the chain assembly, the product is released from the solid phase to the solution, deprotected, and collected. The occurrence of side reactions sets practical limits for the length of synthetic oligonucleotides (up to about 200 nucleotide residues), because the number of errors increases with the length of the oligonucleotide being synthesized. Products are often isolated by HPLC to obtain the desired oligonucleotides in high purity.

Chemically synthesized oligonucleotides find a variety of applications in molecular biology and medicine. They are most commonly used as antisense oligonucleotides, small interfering RNA, primers for DNA sequencing and amplification, probes for detecting complementary DNA or RNA via molecular hybridization, tools for the targeted introduction of mutations and restriction sites, and for the synthesis of artificial genes.

In the context of the invention, chemically synthetized RNA may be used for enzymatic polyadenylation.

RNA in vitro transcription: "RNA in vitro transcription" is a method that allows for template-directed synthesis of RNA molecules of any sequence in a cell free system (in vitro). It is based on the engineering of a template that includes a bacteriophage promoter sequence (e.g. from the T7 coliphage) upstream of the sequence of interest followed by transcription using the corresponding RNA polymerase.

Particular examples of DNA-dependent RNA polymerases are the T7, T3, and SP6 RNA polymerases. A DNA template for RNA in vitro transcription may be obtained by cloning of a nucleic acid, in particular cDNA corresponding to the respective RNA to be in vitro transcribed, and introducing it into an appropriate vector for RNA in vitro transcription, for example into plasmid DNA. In a preferred embodiment of the present invention, the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Methods for RNA in vitro transcription are known in the art (Geall et al. (2013) *Semin. Immunol.* 25(2): 152-159; Brunelle et al. (2013) *Methods Enzymol.* 530:101-14). An exemplary reaction mix used in said method typically includes:

1) a linearized DNA template with a promoter sequence that has a high binding affinity for its respective RNA polymerase such as bacteriophage-encoded RNA polymerases;

2) ribonucleoside triphosphates (NTPs) for the four bases (adenine, cytosine, guanine and uracil);

3) optionally, a cap analog as defined below (e.g. m7G (5')ppp(5')G (m7G));

4) optionally, another modified nucleotide as defined below;

5) a DNA-dependent RNA polymerase capable of binding to the promoter sequence within the linearized DNA template (e.g. T7, T3 or SP6 RNA polymerase);

6) optionally a ribonuclease (RNase) inhibitor to inactivate any contaminating RNase;

7) a pyrophosphatase to degrade pyrophosphate, which inhibits transcription;

8) $MgCl_2$, which supplies $Mg^{2+}$ ions as a co-factor for the polymerase;

9) a buffer to maintain a suitable pH value, which can also contain antioxidants (e.g. DTT), and/or polyamines such as spermidine at optimal concentrations, commonly based on Tris-HCl or HEPES.

In vitro transcribed RNA may be used in analytical techniques (e.g. hybridization analysis), structural studies (for NMR and X-ray crystallography), in biochemical and genetic studies (e.g. as antisense reagents), as functional molecules (ribozymes and aptamers) and in (genetic) vaccination, gene therapy and immunotherapy. In the context of the invention, in vitro transcribed RNA may be used for enzymatic polyadenylation.

DETAILED DESCRIPTION OF THE INVENTION

To solve the above mentioned problems, the present invention uses a poly(N)polymerase, or preferably a poly (A)polymerase, particularly a bacterial poly(A)polymerase immobilized onto a solid support.

The poly(N/A)polymerase may be immobilized onto the solid support by virtually any method. Preferably, the immobilization is via covalent binding, affinity binding, physical adsorption, encapsulation or entrapment. More preferably, the immobilization is via covalent binding between the PNP/PAP and the solid support.

The immobilization may be via any amino acid side chain of the PNP/PAP enzyme or via the N- or C-terminus. Any coupling reaction may be employed including click-chemistry or amino-activated Sephadex G-10 for coupling through free carboxyl groups. However, the immobilization should consider that the enzyme needs to be accessible for the reaction substrates, i.e. the RNA molecules and the nucleotides. It should further consider enough space for the emerging poly(N/A) tail at the RNA molecule. It is generally known in the art that immobilization of enzymes such as the PNP/PAP of the invention should avoid steric hindrances, enzyme aggregation and denaturation (Mateo et al. (2007) Enzyme and Microbial Technology 40.6: 1451-1463.). Hence, it is beneficial to immobilize the PNP/PAP via an amino acid which is located on the surface of the protein when correctly folded into its 3-dimensional form and is not within the active center of the enzyme, i.e. not catalytically involved in the transfer of the nucleoside monophosphate or nucleoside analog monophosphate from the respective nucleoside or nucleoside analog triphosphate to (poly(N/A)) RNA. This aspect is important so that the PNP/PAP retains its biological activity although immobilized onto a solid support.

In general, immobilization of an enzyme can be performed in manifold ways, as exemplified in various reviews, including (Datta et al. (2013) 3 Biotech 3.1: 1-9; Kim and Herr (2013) Biomicrofluidics 7.4: 041501).

Figure 1:
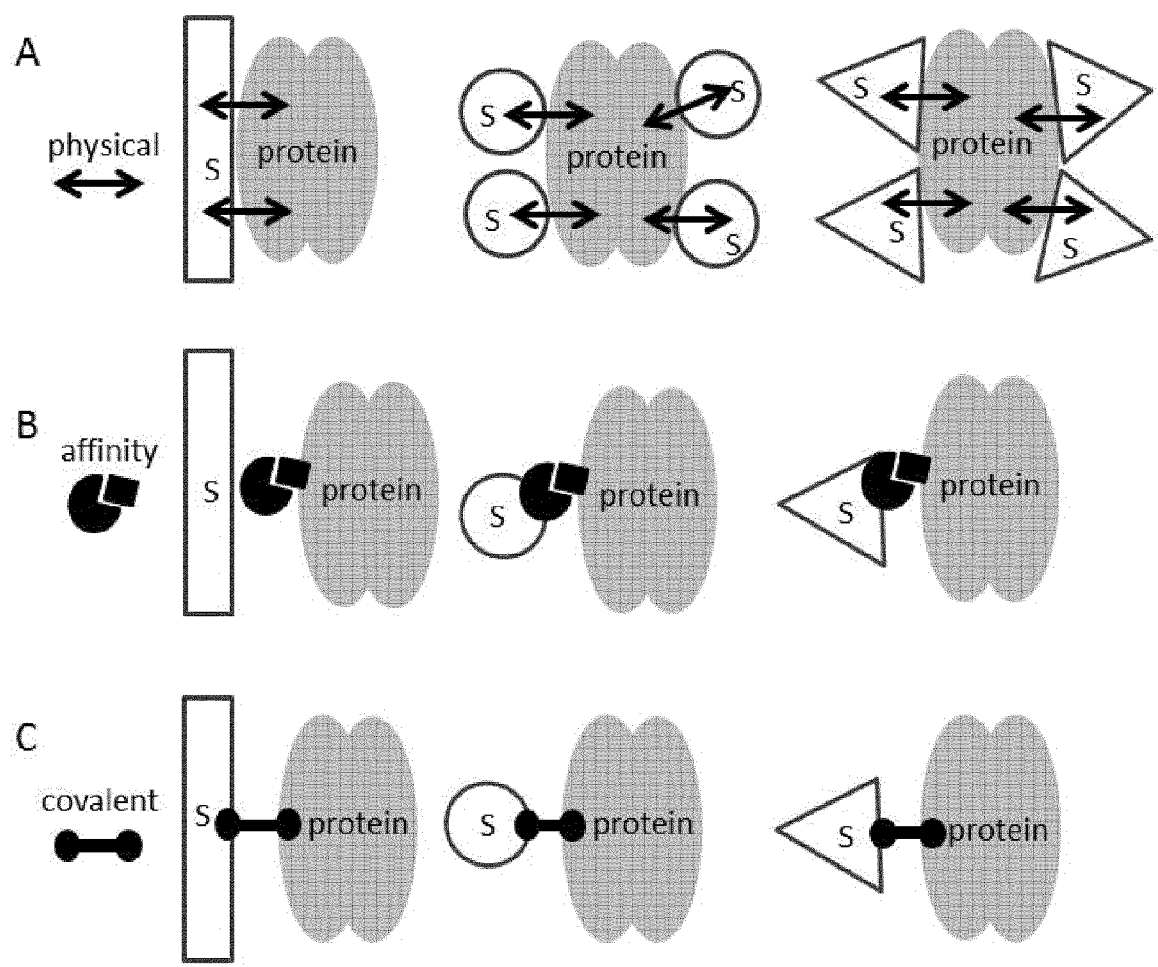
FIG. 1: Immobilization procedures for a poly(N/A)polymerase: Poly(N/A)polymerase (protein) may be coupled by passive physical forces (A), by affinity capture (B) or by covalent bond (C) to a suitable support material (S). As support materials, a planar surface (elongated rectangle), and two different globular supports are exemplified (round circle, triangle), such as beads. (A): The coupling via physical adsorption (arrow) can occur on various, often random residues on a protein. Physical adsorption is based on weak physical intermolecular interactions including electrostatic, hydrophobic, van der Waals, and hydrogen bonding interactions. (B): The coupling via affinity, comprising bio-affinity, can occur on specified positions on a protein. Bio-affinity immobilization is based on strong interactions of two biomolecules, where one interacting partner is fused to the protein (black square), and the other interacting partner is coated on the respective support material (black circle). (C): The coupling via covalent bond (bar-bell) can occur via specific reactive residues on a protein, such as cysteine residues. A covalent bond is a strong chemical bond. Reactive residues on the protein and reactive groups on the support material, as described herein, need to be present to form covalent bonds.

Coupling strategies mainly comprise, but are not limited to, entrapment, encapsulation, physical adsorption, bio-affinity interactions, and covalent bond. A schematic representation of possible immobilization strategies for the PNP/PAP of the present invention is given in FIG. 1.

An immobilization support, i.e. the solid support of the invention, may comprise metals, silicon, glass, polydimethylsiloxane (PDMS), plastic materials, porous membranes, papers, alkoxysilane-based sol gels, agarose, sepharose, polymethylacrylate, polyacrylamide, cellulose, and silica, monolithic supports, and expanded-bed adsorbents.

Preferably, the poly(N)polymerase or poly(A)polymerase is immobilized onto the solid support by covalent binding.

Covalent immobilization is generally preferred and considered to have the advantage that the respective protein to immobilize and the corresponding solid support have the strongest and most stable binding, which is supposed to minimize the risk of proteins to dissociate from the solid support, also referred to as enzyme leakage.

To achieve binding of the PNP/PAP to the solid support, the respective solid support has to be chemically activated via reactive reagents. Then, the activated solid support reacts with functional groups on amino acid residues and side chains of the PNP/PAP to form covalent bonds.

Functional groups which are suitable for covalent binding comprise, but are not limited to, primary amines (—$NH_2$) existing at the N-terminus of each polypeptide chain and in the side-chain of lysine (Lys, K), α-carboxyl groups, such as at the C-terminus, and the β- and γ-carboxyl groups of aspartic and glutamic acid, and sulfhydryl or thiol groups of cysteines. These functional groups are preferably located on the solvent exposed surface of the correctly 3-dimensionally folded PNP/PAP.

Primary amines (—$NH_2$) provide a simple target for various immobilization strategies. This involves the use of chemical groups that react with primary amines. Primary amines are positively charged at physiologic pH; therefore, they occur predominantly on the outer surfaces of the protein and are mostly accessible to immobilization procedures.

Suitable solid support materials for immobilization via primary amines comprise, but are not limited to, formaldehyde and glutaraldehyde activated support materials, 3-aminopropyltriethoxysilane (APTES) activated support materials, cyanogen bromide (CnBr) activated support materials, N-hydroxysuccinimide (NHS) esters and imidoesters activated support materials, azlactone activated support materials, and carbonyl diimidazole (CDI) activated support materials.

The carboxyl group is a frequent moiety (—COOH) at the C-terminus of each polypeptide chain and in the side chains of aspartic acid (Asp, D) and glutamic acid (Glu, E), usually located on the surface of the protein structure. Carboxylic acids may be used to immobilize PNP/PAP through the use of a carbodiimide-mediated reaction. 1-ethyl-3-(3-dimethylaminoipropyl) carbodiimide (EDC) and other carbodiimides cause direct conjugation of carboxylates (—COOH) to primary amines (—$NH_2$).

Possible solid supports comprise, but are not limited to, diaminodipropylamine (DADPA) agarose resin that allows direct EDC-mediated crosslinking, which usually causes random polymerization of proteins.

In a preferred embodiment of the invention, covalent immobilization is via a unique and mutually reactive group on the protein's surface (e.g., thiol group of cysteine) and the solid support (e.g., thiol activated solid support, such as thiol or maleimide activated sepharose or epoxy activated support such as epoxy methacrylate). Furthermore, the reaction between the two reactive groups should be highly selective. Also, the coupling reaction should work efficiently under physiological conditions (i.e., in aqueous buffers around neutral pH) to avoid the denaturation of the protein during the immobilization step. Finally, it is desirable that the reactive group on the protein can be obtained using recombinant protein expression techniques or is already naturally present on the protein's surface.

Many reactive groups used for covalent immobilization (see above) are commonly present multiple times in a protein. Due to the strong nature of covalent bonds, multiple bonds could, however, alter the 3-D conformation or destroy the catalytic core or other relevant protein domains. Therefore, complicated chemistry is often required to achieve oriented immobilization of enzymes (e.g., chemical blocking of other reactive groups in the enzyme such as ethanolamine to block excessive reactive amine groups). Site-specific covalent immobilization would allow the enzymes to be immobilized in a definite, oriented fashion. However, this process requires the presence of unique and mutually reactive groups on the protein (e.g., thiol group of cysteine) and the support (e.g., thiol activated sepharose). Furthermore, the reaction between the two reactive groups should be highly selective. Also, the coupling reaction should work efficiently under physiological conditions (i.e., in aqueous buffers around neutral pH) to avoid the denaturation of the protein during the immobilization step. Finally, it is desirable that the reactive group on the protein can be obtained using recombinant protein expression techniques.

Thiol groups, also called sulfhydryl groups, which have the structure R—SH, allow a selective immobilization of proteins and peptides as they commonly occur in lower frequencies (Hansen et al. (2009) Proc. Natl. Acad. Sci. USA 106.2: 422-427). Thiol groups may be used for direct immobilization reactions of PNP/PAPs to activated solid support materials, forming either thioether linkages (R—S—R) prepared by the alkylation of thiols or disulfide bonds (R—S—S—R) derived from coupling of two thiol groups. The thiol groups necessary for those reactions may have different sources:

a) Thiol groups of inherent or native free cysteine residues, in particular thiol groups which do not participate in disulfide bridges of the correctly 3-dimensionally folded protein.
 b) Often, as part of a protein's secondary or tertiary structure, cysteine residues are joined together between their side chains via disulfide bonds. Thiol groups can be generated from existing disulfide bridges using reducing agents.

c) Thiol groups can be generated using thiolation reagents, which add thiol groups to primary amines.

d) Thiol groups can be genetically introduced by adding a cysteine residue at the C- or N-terminus or substituting an amino acid residue within the protein with another amino acid, particularly a cysteine. Thiol groups may also be introduced by introducing a cysteine residue into the natural amino acid sequence, preferably in a region of the protein which is neither important for the catalytic activity of the protein nor important for its structural integrity, such as often loop or turn structures.

In a preferred embodiment, PNP/PAPs are covalently coupled to the solid support via the thiol group of cysteine (native or introduced) to a support material, more preferably they are coupled via a disulfide bond to a thiol-activated solid support, via a or a thioether bond to a maleimide-activated solid support or to a pyridyl disulfide-functionalized solid support or to an epoxy activated support, more preferably to a thiol-activated solid support, via a thioether bond to a maleimide-activated solid support or to a pyridyl disulfide-functionalized solid support. Thiol-activated solid support contains chemical groups which are capable of reacting with the thiol group of the PNP/PAP, such as maleimides, epoxy, haloacetyls and pyridyl disulfides. Suitable solid supports include thiol sepharose, thiopropyl-sepharose, thiol-activated sephadex, thiol-activated agarose, silica-based thiol-activated matrix, silica-based thiol-activated magnetic beads, and epoxy methacrylate beads. More preferably, thiol-activated solid support contains chemical groups which are capable of reacting with the thiol group of the PNP/PAP, such as maleimides, haloacetyls and pyridyl disulfides. Even more preferred, suitable solid supports include thiol sepharose, thiopropyl-sepharose, thiol-activated sephadex, thiol-activated agarose, silica-based thiol-activated matrix, and silica-based thiol-activated magnetic beads. Specific examples of thiol-activated sepharose are Thiol Sepharose 4B HiTrap or Thiol Sepharose 4B. Suitable pyridyl disulfide-functionalized supports include nanoparticles such as Nanosprings® of STREM chemicals or any amine-containing support thiolated by an N-Hydroxysuccinimide-pyridyl disulfide like NHS-PEG$_4$-pyridyl disulfide. In further examples, the solid support comprises pyridyl disulfide-functionalized nanoparticles and/or maleimide-activated agarose.

The solid support may be a mixture of the solid supports mentioned herein. However, it is preferred to have the same functional group presented on the solid support, i.e. the thiol group. For example, in one single enzyme reactor thiol sepharose, thiopropyl-sepharose and thiol-activated sephadex may be used for immobilization of the PNP/PAP.

Preferably, the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, maleimide-activated agarose, epoxy methacrylate beads, and mixtures thereof. Preferably, the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, maleimide-activated agarose, and mixtures thereof.

In a preferred embodiment of the invention, the solid support according to the present invention is Thiopropyl Sepharose 6B (provided e.g. by GE Healthcare).

The inventors consider this strategy to be generally advantageous because, commonly, a low number of free existing thiol groups exist in the amino acid sequence of enzymes (Hansen et al. (2009) Proc. Natl. Acad. Sci. USA 106.2: 422-427).

This allows for a virtually site-specific and efficient way of immobilization. Such an oriented immobilization is preferred. Additionally, this immobilization strategy may avoid multiple coupling events to the solid support. Moreover, the covalent coupling via thiol groups of the respective PNP/PAP may have the advantage of a very strong bond that, most importantly, minimizes the danger of an uncontrolled dissociation of support material and enzyme.

If a PNP/PAP may be covalently coupled via the thiol group of a cysteine to the solid support, several aspects should be considered by a person skilled in the art:

I) If several cysteine residues are present in the primary protein structure, free thiol groups, meaning cysteine residues not linked to other cysteine residues via disulfide bridges, may be identified using disulfide bridge prediction algorithms (Yaseen, Ashraf, and Yaohang Li. *BMC bioinformatics* 14.Suppl 13 (2013): S9.).

II) The freely existing thiol groups should not be present in the catalytic core or other functionally or structurally relevant parts of the PNP/PAP since this would lower or could even destroy the enzymatic activity of the enzyme. Optionally, a person skilled in the art may first conduct the present literature on the structure of PNP/PAP or literature on structure-function relationships to identify such potential cysteine residues.

III) If several free thiol groups are present in the primary sequence of the protein, that are not located in the catalytic core or other functionally or structurally relevant parts of the PNP/PAP, respective cysteines may be substituted with a different amino acid, preferably serine (similar size) or alanine (similar charge) or valine, preferably by genetic means. This may help to avoid multiple coupling events to the solid support. Protein visualization tools (e.g., PDB viewer, Guex and Peitsch (1997) Electrophoresis 18: 2714-2723) may help a person skilled in the art to decide whether respective cysteine residues should be substituted in the PNP/PAP. Alternatively, the skilled person may easily employ any of the immobilization strategies described herein and test the PNP/PAP for its catalytic activity. Moreover, the effect of certain cysteine substitutions and/or point mutations can also be estimated, even without structural knowledge, using machine-learning based prediction tools (Rost et al. (2004) Nucl. Acids Res. 32.suppl 2: W321-W326).

IV) If free thiol groups are present in the amino acid sequence of the respective PNP/PAP, a person skilled in the art may also use recent literature on the respective protein structure, if available, to assess if these cysteine residues are accessible for chemical interactions (i.e., covalent bond to a support material), or if these cysteine residues are buried in the interior of the protein's 3-D structure. A person skilled in the art may use algorithms to predict if a respective cysteine is buried or freely accessible by performing calculations comprising residue depth calculations or solvent-accessible surface area calculations (Xu, Dong, Hua Li, and Yang Zhang. *Journal of Computational Biology* 20.10 (2013): 805-816). Alternatively, the skilled person may easily employ any of the immobilization strategies described herein and test the PNP/PAP for its catalytic activity.

V) If no freely accessible cysteine residues are present in the primary structure of the respective PNP/PAP, cysteine residues may be introduced by various means. For example, cysteine residues may be introduced at the N-terminus or C-terminus of the PNP/PAP by methods comprising genetic engineering, either by extending the N-terminus or the C-terminus or by substitution of the N-terminal-most or C-terminal-most amino acid. Moreover, a person skilled in the art may introduce flexible linkers, in particular, if the N- or C-terminus of the PNP/PAP displays important functional or structural features. Again, cysteine residues may also be introduced into any other suitable regions of the protein by substitution of amino acids within these regions. Ideally, such residues should be located on the protein surface and possibly in loop or turn structures which often do not play a role in the protein's structural integrity or are relevant for its enzymatic activity. Preferably, an amino acid that occupies a similar space in a protein's 3-D structure, such as serine, may be considered for an S to C substitution and vice versa if cysteine residues are to be removed.

Alternatively, or in addition to that, cysteine residues may be substituted with any other amino acid. For example, the wild type PNP/PAP sequence may be aligned with multiple related sequences from other organisms to identify suitable amino acid substitutions that do not influence enzymatic activity. A person skilled in the art will know how to find similar sequences and how to align those sequences and how to identify suitable amino acids for substituting naturally occurring cysteines in a PNP/PAP.

The cysteine residue preferably used for coupling may be present in the wild-type enzyme, i.e. in the natural amino acid sequence of PNP/PAP, if it is in a position suitable for coupling, or it may be introduced into the enzyme's amino acid sequence at a suitable position such as the N- or the C-terminus of the enzyme. The cysteine residue can be coupled to the N- or C-terminus directly, i.e. by forming a peptide bond with the N- or C-terminal amino acid of the wild-type PNP/PAP, or via a linker as defined herein. Alternatively, N- or C-terminal amino acid of the wild-type enzyme may be substituted with a cysteine residue.

Particularly preferred linker elements according to the present invention comprise linker elements as depicted in SEQ ID NOs: 156-180.

In a preferred embodiment of the invention, a flexible linker GGGGSGGGGS (according to SEQ ID NO: 170) is used.

Additionally, any cysteine residue present in the wild-type enzyme which is not suitable for coupling to a solid support may optionally be substituted with another amino acid, such as serine or alanine or valine, to avoid any residual coupling by this cysteine residue.

In an even more preferred embodiment, the PNP/PAP is immobilized by covalent binding to a thiol-activated solid support, pyridyl disulfide-functionalized solid support, or maleimide-activated solid support; highly preferably the PNP/PAP is immobilized by covalent binding to a thiol-activated solid support, pyridyl disulfide-functionalized solid support, epoxy activated support or maleimide-activated solid support. In a particularly preferred embodiment, the PNP/PAP is immobilized via a thiol group of at least one cysteine residue. And most preferably, the covalent binding is a disulfide bridge or a thioether bond.

Preferably, the solid support comprises a member selected from the group consisting of sepharose, thiopropyl-sepharose, sephadex, agarose, silica, magnetic beads and nanoparticles or virtually any other material which can be functionalize with any of the functional groups mentioned herein, in particular with thiol, epoxy, pyridyl disulfide or malemide groups. Also mixtures of the solid support materials may be used.

In a preferred embodiment, the PNP/PAP is immobilized via a thiol group which is present in the naturally occurring PNA/P. In another preferred embodiment, the PNP/PAP is immobilized via a newly introduced thiol group, i.e. via a newly introduced cysteine residue. In another preferred embodiment, the PNP/PAP is immobilized via a thiol group of a cysteine residue while one or more cysteine residues have been removed, i.e. have been replaced by alanine and/or serine residues.

In principle, introduction of cysteine residues in PNP/PAP is possible via the substitution of amino acids with cysteine at any position of the protein primary sequence or by extending the free N- or C-termini. However, several important aspects should be considered by a person skilled in the art if a cysteine residue is to be introduced into PNP/PAP via substitution:

I) Amino acids that are particularly important for the catalytic activity of PNP/PAP should not be substituted to cysteine.

II) Other amino acid residues that are located at the surface of PNP/PAP are potential targets for substitution with cysteine. Particularly, serine residues that have a similar size than cysteine residues may be preferred targets.

III) Amino acids that are not at the surface of PNP/PAP should not be changed to cysteine, as their thiol groups might not in a special position to react with the respective solid support. Moreover, a substitution of residues located in the interior of the protein may locally disrupt the protein structure.

Within the scope of the present invention not only the native PNP/PAP can be used, but also functional variants thereof. Functional variants of the PNP/PAP have a sequence which differs from that of the native PNP/PAP by one or more amino acid substitutions, deletions or additions, resulting in a sequence identity to the native PNP/PAP of at least 80%, preferably of at least 81%, 82%, 83%, 84% or 85%, more preferably of at least 86%, 87%, 88%, 89%, 90%, 91%, 92%, 93% or 94%, even more preferably of at least 95%, 96% and most preferably of at least 97%, 98% or 99%. Variants defined as above are functional variants, if they retain the biological function of the native and naturally occurring enzyme, i.e. the ability to polynucleotidylate or polyadenylate RNA. The enzyme activity of the functional variant of PNP/PAP is at least 50%, 60% or 70%, preferably at least 75%, 80% or 85%, more preferably at least 87%, 89%, 91% or 93% and most preferably at least 94%, 95%, 96%, 97%, 98% or 99% of the native enzyme as derivable from *Escherichia coli, Streptomyces coelicolor, Meiothermus silvanus, Bacillus subtilis, Thermus aquaticus, Shigella flexneri, Shigella dysenteriae, Citrobacter koseri, Salmonella bongori, Salmonella enterica, Trabulsiella guamensis, Kluyvera ascorbata, Citrobacter freundii, Enterobacter cloacae, Enterococcus gallinarum, Grimontia indica*, or *Salinivibrio costicola*, such as PAP-I of *E. coli*.

Preferably, the poly(N/A)polymerase comprises an amino acid sequence being at least 80%, 85%, 90%, 95%, 98% or 99% identical to an amino acid sequence as depicted in SEQ ID NOs: 1 to 22, 24 to 155 and 203. More preferably, the poly(N/A)polymerase comprises an amino acid sequence being at least 95% identical to an amino acid sequence as depicted in SEQ ID NOs: 1 to 15. More preferably, the poly(N/A)polymerase comprises an amino acid sequence being at least 95% identical to an amino acid sequence as depicted in SEQ ID NOs: 16 to 22, 24 to 155 and 203. SEQ ID NOs: 16 to 22, 24 to 155 and 203 are mutant sequences, wherein additional cysteine residues have been introduced to facilitate binding to a solid support or cysteine residues have been removed, e.g. by substitution with alanine and/or serine and/or valine residues to have a site-directed binding to the solid support. In SEQ ID NOs: 18, 20, 22, 58 to 84 and 143 to 145, a glycine linker, e.g. an amino acid sequence of 6 glycine residues has been attached to the C-terminus serving as a linker to a C-terminal cysteine. Such linkers also facilitate binding of the enzyme to a solid support while allowing flexibility of the polypeptide chain that may be required for enzymatic activity.

In SEQ ID NOs: 85 to 112, 146 to 149 and 154 a flexible linker, e.g. an amino acid sequence according to the sequence GGGGSGGGGS has been attached to the C-terminus serving as a linker to a C-terminal cysteine. Such linkers may also facilitate binding of the enzyme to a solid support while allowing flexibility of the polypeptide chain that may be required for enzymatic activity.

In SEQ ID NOs: 113 to 140, 150 to 153, 155 and 203 a flexible linker and an oligo histidine stretch, e.g. an amino acid sequence according to the sequence GGGGSGGGGSHHHHHH has been attached to the C-terminus serving as a linker to a C-terminal cysteine. The oligo histidine stretch may be used for the purification of the engineered protein (e.g., when expressed in a heterologous system, e.g. in bacteria). Further examples of affinity/purification tags are given in SEQ ID NOs: 181-201.

When residues are to be introduced to serve as attachment point for immobilization onto a solid support, such as cysteine residues, this may be done at the N- or C-terminus or within the amino acid sequence.

Prior to amending the amino acid sequence, it is useful to use 3D structural data to evaluate whether the respective part of the sequence is relevant to the protein's structural integrity or plays a role in the enzymatic activity of PNP/PAP. The same applies if a residue is to be replaced or removed within the amino acid sequence. A residue, such as a cysteine residue, for immobilizing the enzyme to a solid support should be solvent exposed and not be relevant to the enzyme's structural integrity or biological function. Thereby, Cys 346 in SEQ ID NO: 1 was identified to be solvent exposed and thus suitable for immobilizing the PNP/PAP to a solid support. Most preferably, the poly(N/A)polymerase comprises an amino acid sequence being identical to an amino acid sequence as depicted in SEQ ID NOs: 1 to 22, 24 to 155 and 203.

Particularly preferred, the poly(N)polymerase is a poly(A)polymerase, preferably poly(A)polymerase I (PAP-I), optionally derived from *E. coli*, such as *Escherichia coli* B7A (Toh et al., 2011), which is encoded by the pcnB gene (SEQ ID NO: 1).

Preferably, the poly(A)polymerase of the invention comprises an amino acid sequence being at least 50%, at least 55%, at least 60%, at least 65%, at least 70%, at least 75%, more preferably at least 80% or at least 85%, even more preferably at least 90%, or 95% or most preferably at least 98% or 99% identical to any of the amino acids depicted in SEQ ID NOs: 1 to 22, 24 to 155 and 203 or to a native PNP/PAP sequence existing in nature.

Moreover, in embodiments where a flexible 6 x Glycine linker (e.g. SEQ ID NOs: 18, 20, 22, 58-84 and 143-145) is used, or in embodiments where a flexible GGGGSGGGGS linker (e.g. SEQ ID NOs: 85-112, 146-148 and 154) is used, those linkers can also be designed differently (other Glycine-Serine-linkers, different linker length, etc.), such as linker elements depicted in SEQ ID NOs: 156-180.

Moreover, in embodiments where a purification tag has been introduced (e.g., SEQ ID NOs: 113-140, 150-153, and 155), those purification tags may also be designed differently, e.g. according to purification tags SEQ ID NOs: 181-201.

In another preferred embodiment, the poly(N/A)polymerase comprises at least one newly introduced cysteine residues compared to a native poly(N/A)polymerase. Preferably, the PNP/PAP of the invention comprises only one cysteine residue or is mutated to comprise only one cysteine residue (cf. Example section), e.g. according to SEQ ID NOs: 16-22, 24-83, 85-111, 113-139, 141-144, 146-148, 150-152, 154-155 or 203.

In addition to the definition of "newly introduced amino acids", the newly introduced amino acid, such as the newly introduced cysteine residue, may be introduced into the native or a mutated amino acid sequence between two amino acid residues already existing in the native or mutated amino acid sequence or may be introduced instead of an amino acid residue already existing in the native or mutated amino acid sequence, i.e. an existing amino acid is exchanged for the newly introduced amino acid sequence. In addition, certain amino acids or amino acid stretches (or tags) suitable for the purification of the recombinant enzyme may be introduced, e.g. such as oligo-histidine tags (HIS tag), FLAG tags, etc.

It is possible to identify the residues in the variant or mutant which correspond to those in the wild-type enzyme by aligning the amino acid sequences of the wild-type and variant enzymes using alignment software known to the skilled person.

In a preferred embodiment of the invention, the poly(A) polymerase is a mutated *Escherichia coli* PAP according to SEQ ID NO.: 113. In said mutated PAP, all natural cysteine residues have been substituted with an alanine. Moreover, the mutated PAP additionally comprises a C-terminal flexible linker and an oligo histidine stretch and a C-terminal cysteine (see Example section). The inventors show that said enzyme is active in solution, and that it stays active when immobilized onto a solid support.

The solid support optionally comprises a member selected from the group consisting of sepharose, thiopropyl-sepharose, sephadex, agarose, silica, magnetic beads, nanoparticles, for example Nanosprings™ (obtainable from STREM chemicals, Cambridge, UK), epoxy methacrylate beads, and mixtures thereof.

In a preferred embodiment, the solid support is Thiopropyl Sepharose 6B.

Several different approaches exist in the art to bind the respective solid support to thiol group containing proteins. Thiol-reactive chemical groups present on thiol-activated support materials include maleimides, epoxy, haloacetyls, pyridyl disulfides and other disulfide reducing agents. Most of these groups conjugate to thiols on the respective protein by either alkylation (usually the formation of a thioether bond) or disulfide exchange (formation of a disulfide bond). The terms "functionalized" and "activated" with respect to the solid support are used interchangeable and refer to the chemical group which is available on the surface of the solid support for immobilization o the PNP/PAP.

Maleimide-activated reagents react specifically with thiol groups (—SH) at near neutral conditions (pH 6.5-7.5) to form stable thioether linkages. The maleimide chemistry is the basis for most crosslinkers and labeling reagents designed for conjugation of thiol groups. Thiol-containing compounds, such as dithiothreitol (DTT) and beta-mercaptoethanol (BME), must be excluded from reaction buffers used with maleimides because they will compete for coupling sites.

Haloacetyls react with thiol groups at physiological pH. The reaction of the iodoacetyl group proceeds by nucleophilic substitution of iodine with a sulfur atom from a thiol group, resulting in a stable thioether linkage. Using a slight excess of the iodoacetyl group over the number of thiol groups at pH 8.3 ensures thiol selectivity. Histidyl side chains and amino groups react in the unprotonated form with iodoacetyl groups above pH 5 and pH 7, respectively. To limit free iodine generation, which has the potential to react with tyrosine, histidine and tryptophan residues, iodoacetyl reactions and preparations should be performed in the dark.

Pyridyl disulfides react with thiol groups over a broad pH range (the optimum is pH 4 to 5) to form disulfide bonds. During the reaction, a disulfide exchange occurs between the molecule's —SH group and the reagent's 2-pyridyldithiol group. As a result, pyridine-2-thione is released and can be measured spectrophotometrically ($A_{max}$=343 nm) to monitor the progress of the reaction. These reagents can be used as crosslinkers and to introduce thiol groups into proteins. The disulfide exchange can be performed at physiological pH, although the reaction rate is slower than in acidic conditions. Further information on pyridyl disulfide reactive groups can be taken from van der Vlies et al. (2010, Bioconjugate Chem., 21 (4), pp 653-662).

Another very potent solid support is an epoxy functionalized solid support. Epoxy comprises the functional group as depicted in Formula (I):

(I)

Epoxy-activated matrices can be used for coupling ligands stably through amino, thiol, phenolic or hydroxyl groups depending on the pH employed in the coupling reaction. Immobilization via epoxy groups is also described by Mateo et al., "Multifunctional epoxy supports: a new tool to improve the covalent immobilization of proteins. The promotion of physical adsorptions of proteins on the supports before their covalent linkage", Biomacromolecules 1.4 (2000): 739-745. If the immobilization reaction takes place at a pH between 7.5-8.5, i.e. at physiological conditions, the attachment occurs at thiol groups, if the reaction takes place at a pH between 9 and 11, attachment occurs at amine residues and if the reaction takes place at a pH above 11, the attachment occurs at hydroxyl groups.

Suitable solid supports include thiol sepharose, thiopropyl sepharose, thiol-activated sephadex, thiol-activated agarose, silica-based thiol-activated matrix, silica-based thiol-activated magnetic beads, pyridyl disulfide-functionalized nanoparticles, maleimide-activated agarose, epoxy methacrylate beads and mixtures thereof. There are several commercially available thiol-activated support materials comprising thiol-activated sepharose such as Thiol Sepharose 4B (GE Healthcare, Chalfont St Gile, UK) and thiol-activated agarose that are preferably be used to immobilize thiol-group-containing PNP/PAPs. Particularly preferred solid support materials are selected from the group consisting of thiol-activated solid support, haloacetyl functionalized solid support, pyridyl disulfide-functionalized solid support, maleimide-activated solid support and mixtures thereof. Most preferred are a thiol-activated solid support and a maleimide-activated solid support. Preferred is a solid support selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, maleimide-activated agarose and mixtures thereof. More preferred is a solid support selected from activated thiol sepharose, thiopropyl-sepharose, thiol-activated sephadex, thiol-activated agarose, maleimide-activated agarose and other amine containing support thiolated by an N-Hydroxysuccinimide-pyridyl disulfide like NHS-PEG4-pyridyl disulfide. Most preferably, the solid support is thiol sepharose 4B. Examples of Epoxy-activated resins are Purolite® ECR8205 epoxy methacrylate and Purolite® ECR8214 epoxy methacrylate are e.g. obtainable from Purolite® Corp., Llantrisant, UK, which are produced via crosslinking in the presence of a porogenic agent that allows the control of porosity, or ECR8204F epoxy-methacrylate beads which are obtainable from Lifetech™, Thermo Fisher Scientific, Waltham, Mass. USA). ECR8204F beads are of 150-300 μm diameter (mean=198) and pores of 300-600 Å. In further examples, the solid support comprises pyridyl disulfide-functionalized nanoparticles and/or maleimide-activated agarose.

Sepharose-immobilized PNP/PAP may be re-solubilized using reducing agents such as DTT or mercaptoethanol, or low pH to potentially re-use the support material.

Most preferably, the covalent binding between the solid support and the PNP/PAP is a disulfide bridge or a thioether bond.

Exemplary solid supports are activated thiol sepharose 4B (GE, Fairfield, Conn., USA), thiopropyl-sepharose 6B (GE, Fairfield, Conn., USA), thiol-activated sephadex G-10 (GE, Fairfield, Conn., USA), thiol-activated agarose (Cube Biotech, Monheim, Germany), maleimide-activated agarose (Cube Biotech, Monheim, Germany), or epoxy-activated methacrylate (Purolite® ECR8205 or Purolite® ECR8214).

In other embodiments, the PNP/PAP enzyme is immobilized via of protein entrapment/encapsulation, physical adsorption, bio-affinity immobilization, affinity capture ligands.

In one embodiment, the PNP/PAP is immobilized via protein entrapment/encapsulation. The basic principle of protein entrapment/encapsulation is that the PNP/PAP may be encapsulated in the interior of the respective solid support material, which may prevent enzyme aggregation and enzyme denaturation. Possible solid support materials comprise polyacrylamide gels, sol-gels, lipid vesicles and polymers such as poly (lactic acid) and poly (lactic-co-glycolic acid). Physical adsorption, where the PNP/PAP may bind passively on a particular support material, is based on physical forces such as electrostatic, hydrophobic, van der Waals, and hydrogen bonding interactions. Physical adsorption is based on random binding of the PNP/PAP on multiple anchoring points to the support material.

Possible solid support materials comprise metal, silicon, glass, PDMS, and various adhesive plastic materials.

In one embodiment, the PNP/PAP is immobilized via bio-affinity immobilization. Bio-affinity immobilization strategies exploit the affinity interactions of different biological systems comprising the avidin-biotin system, and affinity capture ligands (His/GST tags). In the widely employed avidin-biotin strategy, partners for biomolecules are avidin (tetrameric glycoprotein from chicken eggs), or neutravidin (deglycosylated version of avidin), or streptavidin (a protein form Streptomyces avidinii with higher affinity than avidin) and biotin (water soluble vitamin-B) that form strong non-covalent interactions. Biotinylated moieties strongly bind avidin/streptavidin. Biotinylation, that is the conjugation of biotin on molecules particularly proteins, does usually not affect functionality or conformation due to its small size. PNP/PAP may chemically or enzymatically be biotinylated. Most chemical biotinylation reagents consist of a reactive group attached via a linker to the valeric acid side chain of biotin. As the biotin binding pocket in avidin/streptavidin is buried beneath the protein surface, biotinylation reagents possessing a longer linker are desirable, as they enable the biotin molecule to be more accessible to binding avidin/streptavidin protein. Chemical biotinylation may occur on several moieties in the PNP/PAP including primary amines (—NH$_2$), thiols (—SH, located on cysteines) and carboxyls (—COOH, a group located at the C-terminus of each polypeptide chain and in the side chains of aspartic acid and glutamic acid). All these above mentioned biotinylation targets in a protein can be used, depending on the respective buffer and pH conditions. For example, free thiol groups (sulfhydryl groups, —SH, located on cysteine side chains) are less prevalent on most proteins. Biotinylation of thiol groups is useful when primary amines are located in the regulatory domain(s) of the target protein or when a reduced level of biotinylation is required. Thiol-reactive groups such as maleimides, haloacetyls and pyridyl disulfides require free thiol groups for conjugation; disulfide bonds must first be reduced to free up the thiol groups for biotinylation. If no free thiol groups are available, lysines can be modified with various thiolation reagents (Traut's Reagent, SAT (PEG4), SATA and SATP), resulting in the addition of a free sulfhydryl. Thiol biotinylation is performed in a pH range of 6.5-7.5.

Possible support materials for immobilizing PNP/PAP using the biotin-avidin strategy comprise, but are not limited to, agarose, sepharose, glass beads, which are coated with avidin or streptavidin. Particularly preferred is agarose and sepharose as solid support.

In one embodiment, the PNP/PAP is immobilized via affinity capture ligands. Affinity capture ligands comprise, but are not limited to, oligohistidine-tag (His$_6$) and (glutathione-S-transferase) GST tags.

The C- or N-terminus of PNP/PAP may be genetically engineered to have a His segment that specifically chelates with metal ions (e.g., Ni$^{2+}$). Ni$^{2+}$ is then bound to another chelating agent such as NTA (nitriloacetic acid), which is typically covalently bound to an immobilization support material. The controlled orientation of immobilized PNP/PAP may be facilitated, as the His tags can in principal be placed to the C- or N-terminus of each protein.

Possible solid support materials comprise, but are not limited to, various nickel or cobalt chelated complexes, particularly preferred are nickel-chelated agarose or sepharose beads.

GST (glutathione S-transferase) may be tagged onto the C- or N-terminus (commonly the N-terminus is used) of PNP/PAPs by genetic engineering. The result would be a GST-tagged fusion protein. GST strongly binds to its substrate glutathione. Glutathione is a tripeptide (Glu-Cys-Gly) that is the specific substrate for glutathione S-transferase (GST). When reduced glutathione (G233SH) is immobilized through its thiol group to a solid support material, such as cross-linked beaded agarose or sepharose, it can be used to capture GST-tagged PNP/PAP via the enzyme-substrate binding reaction.

Possible solid support materials comprise, but are not limited to, glutathione (GSH) functionalized support materials, particularly GSH-coated beads, particularly preferred GSH-coated agarose or sepharose.

Preferably, the PNP of the present invention is selected from a group consisting of poly(A)polymerase, poly(C)polymerase, poly(G)polymerase and poly(U)polymerase.

Preferred are Poly(A/U)Polymerases (Poly(U) polymerase=PUP) of eukaryotes, belonging to the Polymerase beta family, comprising *Homo sapiens* Terminal uridylyltransferase 4 of (uniprot: ZCCHC11), *Schizosaccharomyces pombe* Cit-1 (uniprot: O13833), *Trypanosoma brucei* RNA uridylyltransferase 4 (uniprot: A4UBD5), *Saccharomyces cerevisiae* Poly(A) RNA polymerase protein 2 (uniprot: P53632), whereas Cit-1 of *Schizosaccharomyces pombe* would be preferred.

Most preferably, the PNP of the present invention is a poly(A)polymerase (PAP).

The poly(N/A)polymerase is of bacterial origin. The poly(N/A)polymerase may be derived from any bacterium.

Preferably, the poly(N/A)polymerase is derived from a bacterium selected from the group consisting of *Escherichia coli* (*E. coli*), *Streptomyces coelicolor*, *Meiothermus silvanus* (*M. silvanus*), *Bacillus subtilis*, *Thermus aquaticus* (*T. aquaticus*), *Shigella flexneri*, *Shigella dysenteriae*, *Citrobacter koseri*, *Salmonella bongori*, such as N268-08, *Salmonella enterica*, *Trabulsiella guamensis*, *Kluyvera ascorbata*, such as available from the ATCC Bacteriology Collection, strain No. ATCC 33433, *Citrobacter freundii*, *Enterobacter cloacae*, *Enterococcus gallinarum*, such as strain EGD-AAK12, *Grimontia indica*, and *Salinivibrio costicola*. *T. aquaticus* and *M. silvanus* are thermophilic bacteria. In comparison to *E. coli* derived PNP/PAP, their PNP/PAPs can operate at increased temperatures due to an improved heat stability. Moreover, the improved heat stability may lead to a longer half-life/shelf-life of such immobilized enzymes.

In a preferred embodiment, the PNP/PAP is derived from thermophilic bacteria, such as from the bacterial order "Thermales", that may be used in the context of the present invention, including bacterial PNP/PAP enzymes from the bacteria genus "Thermus", "Meiothermus", "Marinithermus", "Oceanithermus" or "Vulcanithermus".

In a preferred embodiment, the poly(N)polymerase is not a bovine, human or virus-derived poly(A)polymerase.

Preferably, the PNP/PAP is derived from *E. coli, M. silvanus* or *T. aquaticus*.

In a preferred embodiment, the poly(N)polymerase according to the present invention is a poly(A)polymerase and is derived from *M. silvanus* or *T. aquaticus*, e.g. according to SEQ ID NOs.: 2-3, 19-22, and 141-155.

In a particularly preferred embodiment, the poly(N)polymerase according to the present invention is a poly(A)polymerase and is derived from *E. coli*.

Particularly preferred, the poly(N)polymerase is a poly(A)polymerase, preferably poly(A)polymerase I (PAP-I), optionally derived from *E. coli*, such as *Escherichia coli* B7A (Toh et al., 2011), which is encoded by the pcnB gene (SEQ ID NO: 1).

Preferably, the poly(A)polymerase of the invention comprises an amino acid sequence being at least 50%, at least 55%, at least 60%, at least 65%, at least 70%, at least 75%, more preferably at least 80% or at least 85%, even more preferably at least 90%, or 95% or most preferably at least 98% or 99% identical to any of the amino acids depicted in SEQ ID NOs: 1 to 22, 24 to 155, and 203, or to a native PNP/PAP sequence existing in nature.

Moreover, the flexible 6 x Glycine linker embodiments can also be designed differently (Glycine-Serine-linker, different linker length, etc.).

In another aspect, a method is provided for producing the poly(N/A)polymerase of the present invention being a bacterial poly(N/A)polymerase comprising a step of a) contacting the poly(A)polymerase with a solid support under conditions suitable for immobilizing the poly(A)polymerase to the solid support by covalent binding, affinity binding, encapsulation, entrapment or physical adsorption as explained above and as exemplified in the Examples section below. Preferably, the immobilization is via a covalent bond. More preferably, the immobilization in step a) leads to the formation of a disulfide bridge or thioether bond. Specifically, it is preferred that step a) comprises the formation of a covalent bond between a cysteine residue of the poly(N/A)polymerase and a thiol group, a haloacetyl group, an epoxy group, a pyridyl disulfide or a maleimide group of the solid support. In another preferred embodiment, the solid support is a thiol-activated solid support, a haloacetyl functionalized solid support, an epoxy-activated solid support, pyridyl disulfide-functionalized solid support or maleimide-activated solid support.

In an optional embodiment, in step a) of the method of the invention the pH in the reaction buffer is in the range from 5 to 9, preferably 7 to 8, and more preferably at 7.5±0.5.

The reaction buffer used in step a) may comprise a buffering agent as well known to the skilled person. Examples of buffering agents are phosphate buffer, Tris buffer, 4-(2-hydroxyethyl)-1-piperazineethanesulfonic acid (HEPES), acetate buffer and else. Preferably, the buffering agent is a Tris buffer or phosphate buffer, more preferably a phosphate buffer, e.g. $K_2HPO_4$—$KH_2PO_4$. The buffer in step a) may further comprise an inorganic salt, preferably a lyotropic salt, such as a sodium or potassium salt, more preferably, the buffer in step a), also denoted as "coupling buffer" or "immobilization buffer" or "reaction buffer", comprises sodium sulfate or sodium chloride. The inorganic salt may be present in a concentration of at least 0.3 mM, at least 0.4 M, at least 0.5, at least 7.5 M or more preferably at least 10 mM, or more preferably at least 100 mM, even more preferably 500 mM. Optionally, the reaction buffer in step a) may comprise EDTA.

In a preferred embodiment, in step a) the reaction buffer comprises 100 mM $K_2HPO_4$-$KH_2PO_4$, 500 mM NaCl, 1 mM EDTA, at pH 7.5.

After step a), the PPase immobilized to the solid support is washed and stored in storage buffer. The obtained immobilized PPase may be stored in storage buffer at 4-5° C. In a preferred embodiment, after step a) the storage buffer comprises 50 mM Tris-HCl, 500 mM NaCl, 1 mM EDTA, 0.1% Triton X-100, 50% Glycerin, pH 7.5.

It has to be noted that in embodiments where PAP enzyme immobilization is achieved via disulfide bridges, immobilization buffers and storage buffers should not contain reducing agents such as mercaptoethanol or DTT.

Optionally, the method for producing the PNP/PAP further comprises prior to step a) a step of b) expressing the poly(N/A)polymerase in a suitable expression host. The suitable expression host may be selected from a group consisting of a bacterial cell, a yeast cell or a mammalian cell. Preferably, the expression host is a bacterial cell, more preferably *E. coli*. Protein expression can be performed by standard methods well known to the skilled person such as described in Ceccarelli and Rosano "*Recombinant protein expression in microbial systems*", Frontiers E-books, 2014, Merten "*Recombinant Protein Production with Prokaryotic and Eukaryotic Cells. A Comparative View on Host Physiology*", Springer Science & Business Media, 2001, and others. There are also commercial suppliers who produce PNP/PAPs on demand, such as Genscript, Piscataway, N.J., USA.

Optionally, the method of producing the PNP/PAP of the present invention further comprises prior to step a) and, if present, after step b) a step of c) purifying the poly(A)polymerase from an expression host. Protein purification may also be performed via standard procedures know to the skilled person. Further information can be obtained from Janson "*Protein Purification: Principles, High Resolution Methods, and Applications*", John Wiley & Sons, 2012, and Burgess and Deutscher "*Guide to Protein Purification*", Academic Press, 2009.

For the purification of recombinant PAP enzymes, purification tags commonly known in the art may be employed, preferably purification tags according to SEQ ID NOs.: 181-201.

The produced PNP/PAP may be stored in an exemplary buffer comprising 20 mM Tris-HCl, 300 mM NaCl, 1 mM DTT, 1 mM EDTA, 50% Glycerol, 0.1% Triton® X-100, at pH 7.5 and at −20° C.

In one preferred embodiment, the produced and purified PNP/PAP may be stored in 50 mM Tris-HCl, 500 mM NaCl, 1 mM DTT, 0.1 mM EDTA, 0.1% Triton X-100, 50% Glycerol, pH 7.5 at −20° C.

Further provided is the use of a poly(N)polymerase being immobilized onto a solid support for producing polynucleotidylated ribonucleic acid (poly(N)RNA) molecules.

In addition to the definition of "RNA" given above, in preferred embodiments the term "RNA" further encompasses RNA molecules, such as viral RNA, retroviral RNA and replicon RNA, small interfering RNA (siRNA), antisense RNA, CRISPR/Cas9 guide RNA, ribozymes, aptamers, riboswitches, immunostimulating RNA (isRNA), transfer RNA (tRNA), ribosomal RNA (rRNA), small nuclear RNA (snRNA), small nucleolar RNA (snoRNA), microRNA (miRNA), and Piwi-interacting RNA (piRNA) etc.

The production optionally comprises a step of i) contacting the poly(N)polymerase with RNA molecules and nucleotides under conditions suitable for forming a covalent bond between the nucleotides and the RNA molecules. Suitable reaction conditions will be described herein below. The RNA molecules may be virtually of any origin, of any nucleotide composition and of any length.

In a preferred embodiment, the RNA molecules are produced via RNA in vitro transcription using phage RNA polymerases, e.g. T7 RNA polymerase or SP6 RNA polymerase.

In a preferred embodiment, the RNA to be polynucleotidylated or polyadenylated is messengerRNA (mRNA).

The nucleotides used for producing poly(N/A)RNA molecules may be selected from the group consisting of adenosine triphosphate (ATP), cytidine triphosphate (CTP), uridine triphosphate (UTP), guanosine triphosphate (GTP), nucleotide analog and mixtures thereof. Useful nucleotide analogs are virtually any chemical analogs of the standard nucleotides A, U, G and C, i.e. any nucleotide which comprises at least one chemical group or chemical function that does not occur in naturally occurring nucleotides. The only prerequisite is that the nucleotide analog must be a substrate of any PNP/PAP of the present invention which may be tested in a simple polynucleotidylation or polyadenylation reaction, such as described in the Example section. It is also possible to use a mixture of standard nucleotides and nucleotide analogs.

In this context, the modified nucleoside triphosphates as defined herein are nucleotide analogs/modifications, e.g. backbone modifications, sugar modifications or base modifications. A backbone modification in connection with the present invention is a modification, in which phosphates of the backbone of the nucleotides are chemically modified. A sugar modification in connection with the present invention is a chemical modification of the sugar of the nucleotides. Furthermore, a base modification in connection with the present invention is a chemical modification of the base moiety of the nucleotides. In this context, nucleotide analogs or modifications are preferably selected from nucleotide analogs which are applicable for transcription and/or translation.

Sugar Modifications: The modified nucleosides and nucleotides, which may be used in the context of the present invention, can be modified in the sugar moiety. Hence, a "sugar modification" explicitly includes modifications of the sugar moiety of modified nucleosides and nucleotides. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O($CH_2CH_2O$)$_n$$CH_2CH_2OR$; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy. "Deoxy" modifications include hydrogen, amino (e.g. $NH_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O. The sugar group can also contain one or more carbons that possess the opposite stereochemical configuration than that of the corresponding carbon in ribose.

Thus, a modified nucleotide can include nucleotides containing, for instance, arabinose as the sugar.

Backbone Modifications: In the modified nucleosides and nucleotides, also the phosphate backbone may be modified. The phosphate groups of the backbone may be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications: The modified nucleosides and nucleotides, which may be used in the present invention, can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogs/modifications are selected from base modifications, which are preferably selected from 2-amino-6-chloropurineriboside-5'-triphosphate, 2-aminopurine-riboside-5'-triphosphate; 2-aminoadenosine-5'-triphosphate, 2'-amino-2'-deoxy-cytidine-triphosphate, 2-thiocytidine-5'-triphosphate, 2-thiouridine-5'-triphosphate, 2'-fluorothymidine-5'-triphosphate, 2'-O-methyl inosine-5'-triphosphate 4-thio-uridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-bromo-2'-deoxycytidine-5'-triphosphate, 5-bromo-2'-deoxyuridine-5'-triphosphate, 5-iodocytidine-5'-triphosphate, 5-iodo-2'-deoxycytidine-5'-triphosphate, 5-iodouridine-5'-triphosphate, 5-iodo-2'-deoxyuridine-5'-triphosphate, 5-methylcytidine-5'-triphosphate, 5-methyluridine-5'-triphosphate, 5-propynyl-2'-deoxycytidine-5'-triphosphate, 5-propynyl-2'-deoxyuridine-5'-triphosphate, 6-azacytidine-5'-triphosphate, 6-aza-uridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deaza-guanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxy-uridine, 2-methoxy-4-thio-uridine, 4-methoxy-pseudouridine, and 4-methoxy-2-thio-pseudouridine.

In some embodiments, modified nucleosides include 5-aza-cytidine, pseudo-isocytidine, 3-methyl-cytidine, N4-acetylcytidine, 5-formylcytidine, N4-methyl-cytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudo-isocytidine, 4-thio-1-methyl-pseudoisocytidine, 4-thio-1-methyl-1-deaza-pseudo-isocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl)adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methyl-guanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thio-phosphate)-uridine or 5'-O-(1-thiophosphate)-pseudouridine.

In further specific embodiments, the modified nucleotides include nucleoside modifications selected from 6-aza-cytidine, 2-thio-cytidine, α-thio-cytidine, pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, pyrrolo-cytidine, inosine, α-thio-guanosine, 6-methyl-guanosine, 5-methyl-cytidine, 8-oxo-guanosine, 7-deaza-guanosine, N1-methyl-adenosine, 2-amino-6-chloro-purine, N6-methyl-2-amino-purine, pseudo-iso-cytidine, 6-chloro-purine, N6-methyl-adenosine, α-thio-adenosine, 8-azido-adenosine, 7-deaza-adenosine.

Further modified nucleotides have been described previously in WO 2013/052523. The modified nucleotides mentioned in WO 2013/052523 are incorporated herein by reference.

Step i) is preferably, performed for at least 5, 10, 15, 20, 25, 30, 35, 40, 45, 50, 55, 60, 65, 70, 75, 80, 85 or 90 minutes, or even 180 minutes or longer, preferably for at least 5 min or is performed for 180 minutes or longer, preferably at a temperature suitable for the respective enzyme, e.g. at 37±3° C., preferably at 37° C., or at 50-80° C. in case of PNP/PAPS derived from thermophilic bacterial organisms, such as from *Thermus aquaticus* or *M. silvanus* (e.g., according to SEQ ID NOs 2-3, 19-22, 141-155). More preferably, step i) is performed for at least 10 to 120 minutes or is performed for 180 minutes or longer, or at least 10 to 300 minutes, preferably from 15, 20, 25 or 30 to 90 minutes, more preferably from 30 to 60 minutes, more preferably from 30 to 100 minutes, even more preferably from 30 to 200 minutes.

The polynucleotidylation/polyadenylation reaction may be performed in an aqueous solution comprising a buffer and salts. Preferably the reaction is performed at a pH in the range of 6.5 to 8.5, preferably, in the range of 7.0 to 8.0, more preferably, in the range of 7.2 to 8.0, even more preferably at a pH of 7.9±0.1, most preferably at a pH of 7.9.

Suitable buffers are selected from phosphate buffer, tris buffer, acetate buffer and others. Preferably the buffer is a Tris buffer. Suitable salts that may be included in the reaction mixture together with the PN/SP, RNA molecules and the nucleotides are NaCl, $MnCl_2$, $MgCl_2$ and others.

An exemplary polynucleotidylation/polyadenylation reaction buffer comprises 50 mM Tris-HCl, 250 mM NaCl, 10 mM $MgCl_2$, pH 7.9 and may be stored at 25° C. (Cao and Sarkar (1992). Proc. Natl. Acad. Sci. USA. 89, 10380-10384).

Further information on suitable reaction conditions can be found in Bernstein and Ross (1989, Trends Biochem Sci 14:373-377), Gallie (1991, Genes Dev 5:2108-2116), Harland and Misher (1988, Development 102:837-852) and Khaleghpour et al. (2001, Molecular Cell 7:205-216).

In order to obtain a population of nucleic acid molecules, which share approximately the same degree of polyadenylation, i.e. which have approximately the same number of nucleotidylates/adenylates attached to their 3'-ends and thus are essentially homogeneous with respect to the length of the poly(N/A) tail, the polynucleotidylation/polyadenylation reaction should preferably be stopped always after the same incubation time. Preferably, the reaction is stopped by quick separation of the reaction mixture comprising the RNA molecules, the nucleotides and the poly(N/A) RNA molecules from the immobilized PNP/PAPs to avoid introduction of additional chemicals. Standard techniques use heat inactivation, such as 60° C. for at least 20 min. However, in this case, the PAP is denatured and may not be used for further polynucleotidylation reactions.

One important aspect in this respect is the polynucleotidylation/polyadenylation reaction being performed with a molar amount of RNA being less that the molar amount of enzyme and above the affinity of the enzyme to RNA. This leads to saturation of the RNA/poly(N/A) RNA with the enzyme and the polymerization reaction occurs at the same time at all introduced RNA/poly(N/A) RNA molecules. Hence, the amount of nucleotide used determines the length of the poly(N/A) tail. This has the effect that a reproducible average length of poly(N/A) tails at the RNA molecules after a certain period of time may be achieved. Thereby a poly (N/A) tail of considerably the same length and thus poly(N/A) RNA molecules being essentially homogeneous may be obtained, even in timely separated reactions.

In the use of the present invention, a reaction mixture as in step i) comprises 0.5 to 2 mol RNA, preferably from 0.75 to 1.5 mol RNA, more preferably from 0.8 to 1.2 mol RNA, even more preferably from 0.9 to 1.1 mol RNA and most preferably 1 mol RNA. Further, the reaction mixture comprises in step i) from 50 to 500 mol nucleotides, preferably from 75 to 400 mol nucleotides, more preferably from 100 to 300 mol nucleotides, even more preferably from 120 to 200 mol nucleotides and most preferably 150 mol nucleotides. In a preferred embodiment of the present invention, the reaction mixture as in step i) comprises 0.5 to 2 mol RNA and 50 to 500 mol nucleotides, preferably from 0.75 to 1.5 mol RNA and 75 to 400 mol nucleotides, more preferably from 0.8 to 1.2 mol RNA and from 100 to 300 mol nucleotides, even more preferably from 0.9 to 1.1 mol RNA and from 120 to 200 mol nucleotides, and most preferably 1 mol RNA and 150 mol nucleotides.

In the use of the present invention, the reaction mixture comprises in step i) from 50 to 500 mol ATP, preferably from 75 to 400 mol ATP, more preferably from 100 to 300 mol ATP, even more preferably from 120 to 200 mol ATP and most preferably 150 mol ATP. In a preferred embodiment of the present invention, the reaction mixture as in step i) comprises 0.5 to 2 mol RNA and 50 to 500 mol ATP, preferably from 0.75 to 1.5 mol RNA and 75 to 400 mol ATP, more preferably from 0.8 to 1.2 mol RNA and from 100 to 300 mol ATP, even more preferably from 0.9 to 1.1 mol RNA and from 120 to 200 mol ATP, and most preferably 1 mol RNA and 150 mol ATP.

1 mol RNA and 150 mol nucelotides result in a poly(N) tail of about 150 nucleoside residues. Hence, most relevant is the RNA:nucleotide ratio. Since the immobilized PNP/PAP is saturated in the reaction, the RNA molecules are equally nucleotidylated at the same time until depletion of the nucleotides. Thereby the reaction leads to substantially homogeneously polynucleotidylated RNA molecules. Substrate amounts to achieve poly(A)tails of different lengths can easily be calculated by the skilled person based on the information above. If necessary, a standard calibration may be performed.

The skilled person can choose from standard separation techniques (e.g. based on molecular weight or charge), such as chromatographic methods, that are well-known in the art and that are typically employed after polynucleotidylation/polyadenylation in order to separate or purify the reaction products. Therefore, the use of the present invention preferably further comprises a step of ii) isolating the poly(N) RNA molecules by filtration or chromatography. Optionally, the filtration comprises ultrafiltration and/or diafiltration. Suitable filtration and chromatography materials and devices may for example be obtained from GE (Fairfield, Conn., USA), Merck Millipore (Billerica, Mass., USA), Pall Corp. (Port Washington, N.Y., USA). In another preferred embodiment, the PNP/PAP is immobilized onto a solid support which is column material and the nucleotides, RNA molecules and poly(N/A) RNA molecules are in the flow-through of the column.

Preferably, at least 80%, more preferably at least 85%, 90%, 95% or 98% of the polynucleotidylated/polyadenylated RNA molecules are characterized by the same length of the 3'-terminal poly(N/A) sequence. In this context, 'the same length' refers to a situation, where the number of adenylates in the 3'-terminal poly(A) sequence varies from a given value (such as 160 adenylates, 380 adenylates, 430 adenylates, 1000 adenylates, etc.) by not more than 10%, more preferably not more than 9%, 8%, 7%, 6%, 5%, 4%, 3%, 2% or not more than 1%.

Generally, the length of a poly(N/A) tail of the poly(N/A) RNA molecules produced by use of the PNP/PAP of the present invention is greater than 30 nucleotides in length. In another embodiment, the poly(N/A) tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides). Preferably each of the poly(N/A) RNA molecules comprises at least 120 nucleotidylates/adenylates. In some embodiments, the poly (N/A) RNA molecules include from about 30 to about 10,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

Most preferably, the poly(N/A) RNA molecules include from 500 to 5000 nucleotides.

The poly(N/A)RNA molecules produced using the PNP/PAP of the present invention are for use in gene therapy, immunotherapy, e.g. cancer immunotherapy, protein replacement therapy and/or vaccination.

In a preferred embodiment, the nucleotides in the use of the PNP/PAP of the present invention are ATP and the poly(N)RNA molecules are poly(adenylated)RNA (poly(A) RNA) molecules.

Figure 2:
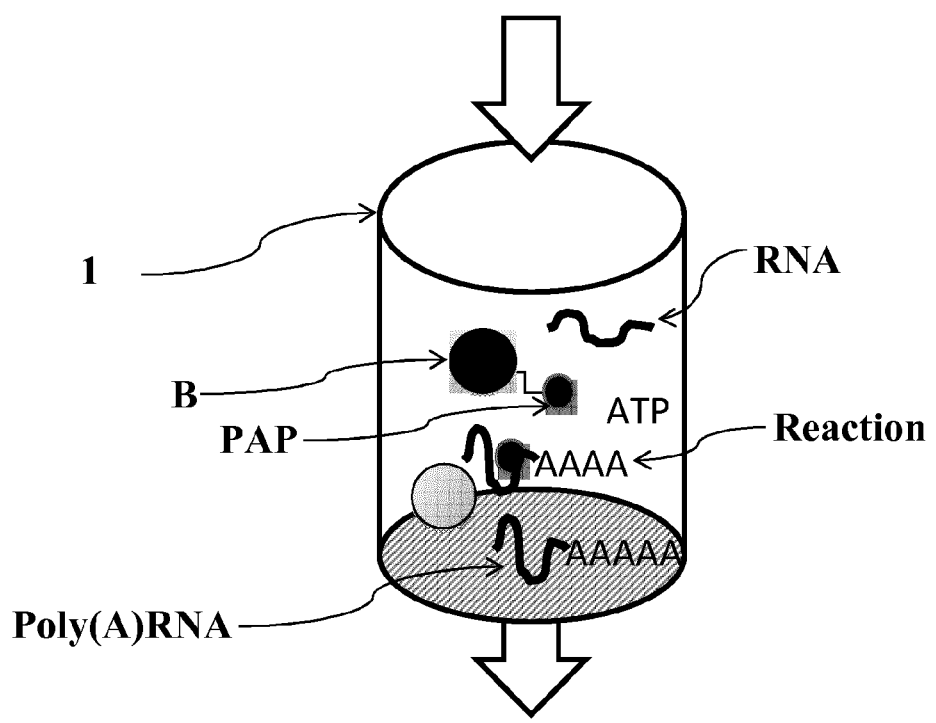
FIG. 2: Schematic representation of a polyadenylation reaction taking place in an enzyme (batch) reactor (1) of the invention. Poly(A)polymerase (PAP) is immobilized onto a solid support, in this case immobilized onto beads (B). The poly(A)polymerases catalyze the attachment of adenylates to RNA resulting in a poly(A) tail covalently attached to the 3'-end of the RNA molecules (Reaction). After the reaction occurred, the poly(A)RNA molecules are separated from the immobilized poly(A)polymerases in the enzyme reactor via an ultrafiltration membrane which does not allow the passage of the poly(A)polymerases immobilized onto—in this exemplary case—beads. The arrow indicates the inlet and outlet tube for introducing and removing components of the reaction into the enzyme reactor vessel.
Figure 4:
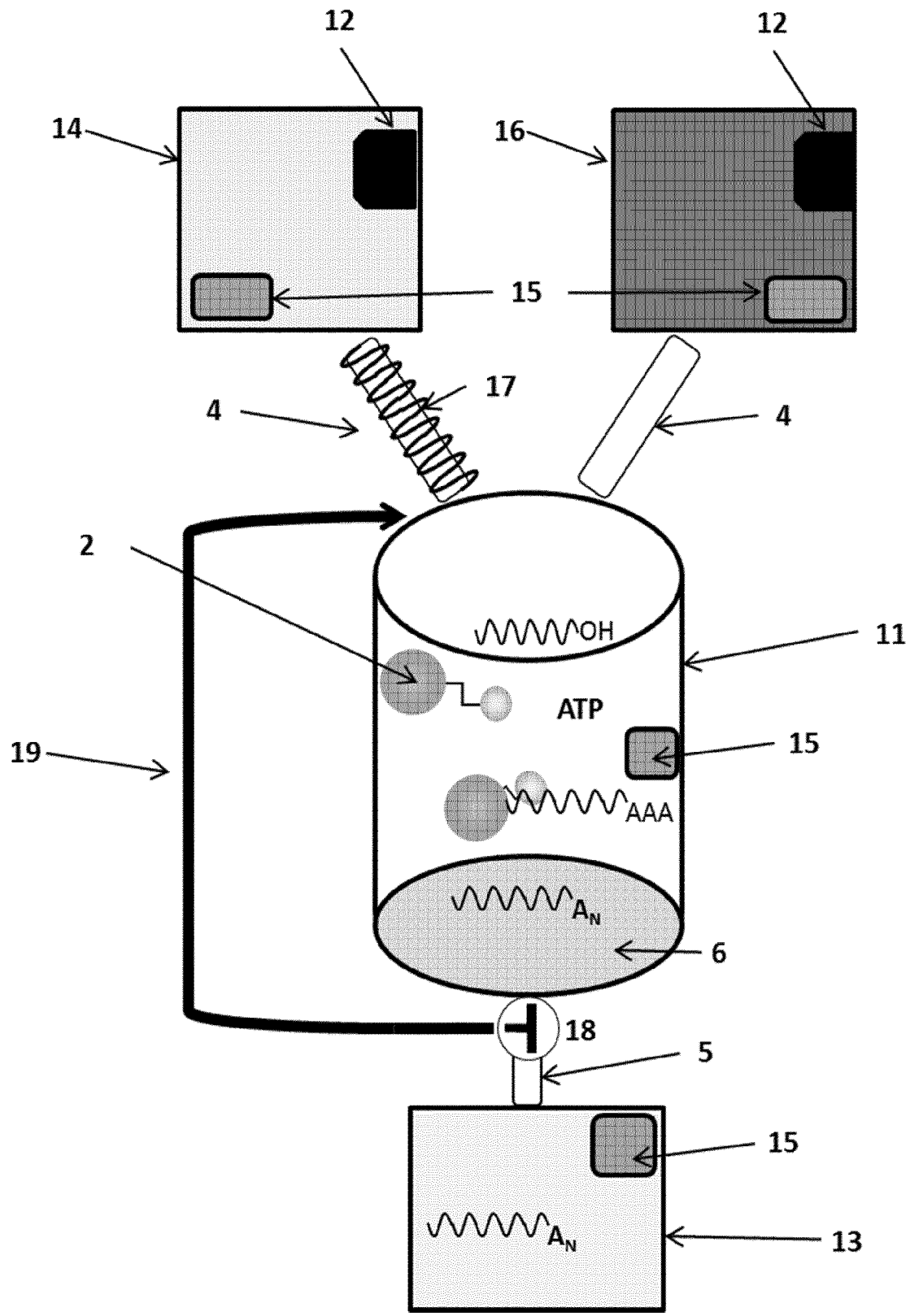
FIG. 4: Schematic representation of a polyadenylation reaction taking place in a reaction module (1) comprised in an enzyme reactor (1) of the invention. In addition to the embodiment shown in FIG. 2, the enzyme reactor further comprises a feed module (14), which contains all essential components for the polyadenylation reaction (buffer, ATP, Ribolock), and an (RNA) in vitro transcription (IVT) module (16) which may have a device for adjusting and controlling the temperature (12) for the template RNA generated in an IVT reaction (16). Moreover, the feed module and the IVT module may have sensor units (15) to monitor essential reaction requirements (pH, temperature, ions, RNA) via UV-light, fluorescence or ion potentiometry, respectively. Furthermore, all components of feed module (14) are heated (heater (17) to reaction temperature during the feed-in flow in the inlet tube (4) to the enzyme batch reactor. An inlet tube (4) is also present between the IVT module (16) and the reaction module (11). Sensor units (15) are also included in the reaction module (11), the capture module (13), the feed module (14) and the IVT module (15). A capture module (13) for temporarily capturing the polyadenylated RNA molecules is connected to the reaction module (11) a filtration device (6), an outlet tube (5) and a control module (18). The control module (18) is able to distinguish RNA according to desired polyA tail lengths. Poly(A)RNAs with desired polyA tail lengths are introduced into the capture module whereas poly(A)RNAs with too short polyA lengths are re-feeded via the reflux module (19) to the reaction module (11).

Further provided is an enzyme reactor comprising a poly(N/A)polymerase of the present invention being immobilized onto a solid support or a poly(N/A)polymerase obtainable by the method as described herein. Exemplary enzyme reactors are depicted in FIGS. 2, 4 and 9.

Optionally, the enzyme reactor further comprises
a) at least one reaction vessel comprising the immobilized poly(N/A)polymerase,
b) one or more devices for measuring/monitoring and/or adjusting at least one parameter selected from the group consisting of pH, osmolality, salt concentration, such as NaCl, magnesium and manganese concentration, phosphate or tris (tris(hydroxymethyl)aminomethane) concentration, temperature, pressure, flow velocity (in-let, outlet-flow), RNA concentration and nucleotide concentration.

In a preferred embodiment, the reaction vessel of the enzyme reactor comprises a thiol-activated solid support, haloacetyl functionalized solid support, pyridyl disulfide-functionalized solid support, epoxy activated solid support or maleimide-activated solid support. Preferably, the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, epoxy-methacrylate beads, and maleimide-activated agarose.

Optionally, the enzyme reactor comprises one or more devices to introduce and/or remove the components of the polynucleotidylation/polyadenylation reaction, such as water, PNP/PAP, RNA molecules, nucleotides, e.g., ATP, UTP, CTP, GTP, nucleotide analogs and mixtures thereof, poly(N/A) RNA molecules, salts, buffer components etc. into or from the enzyme reactor, in particular the reaction vessel of the enzyme reactor.

Further, to provide for a homogeneous substrate distribution within the reaction vessel, the reaction vessel may comprise a stirring device depending on the solid support which is used for immobilization of the PNP/PAP. Clearly, the stirring device and stirring speed should be adjusted to minimize shear forces which might negatively affect the immobilization of the PNP/PAP of the invention. Another method to homogeneously distribute the components of the reaction is a regular movement of the reaction vessel, optionally of the whole enzyme reactor, or a continuous and possibly repeated flow-through of the components of the reaction except of the immobilized PNP/PAP which stays in the reaction vessel.

Any enzyme reactor known to a skilled person or in the art may be used according to the present invention.

In general, an enzyme reactor comprises a vessel or series of vessels, used to perform the desired enzymatic reaction, for example the polynucleotidylation/polyadenylation reaction, particularly by immobilized PNP/PAPs (as defined above). Hence, the enzyme reactor may contain all reaction components necessary to perform the polynucleotidylation/polyadenylation reaction and to produce poly(N/A) RNA molecules.

In one embodiment, an enzyme reactor comprises one or more reaction modules used to perform the desired enzymatic reaction. Hence, the enzyme reactor may contain all reaction components necessary to perform this reaction, also denoted as the reaction mix. The reaction mix at least comprises the immobilized PNP/PAPs and suitable nucleotides and an RNA molecule as substrate. Clearly, further enzymes, buffer components, salts etc. may also be present in the reaction mix depending on the specific application (e.g. in embodiments where the polyadenylation and RNA in vitro transcription is performed simultaneously).

Exemplary embodiments of enzyme reactors according to the present invention are provided in FIG. 2, FIG. 4 and FIG. 9.

Figure 3:
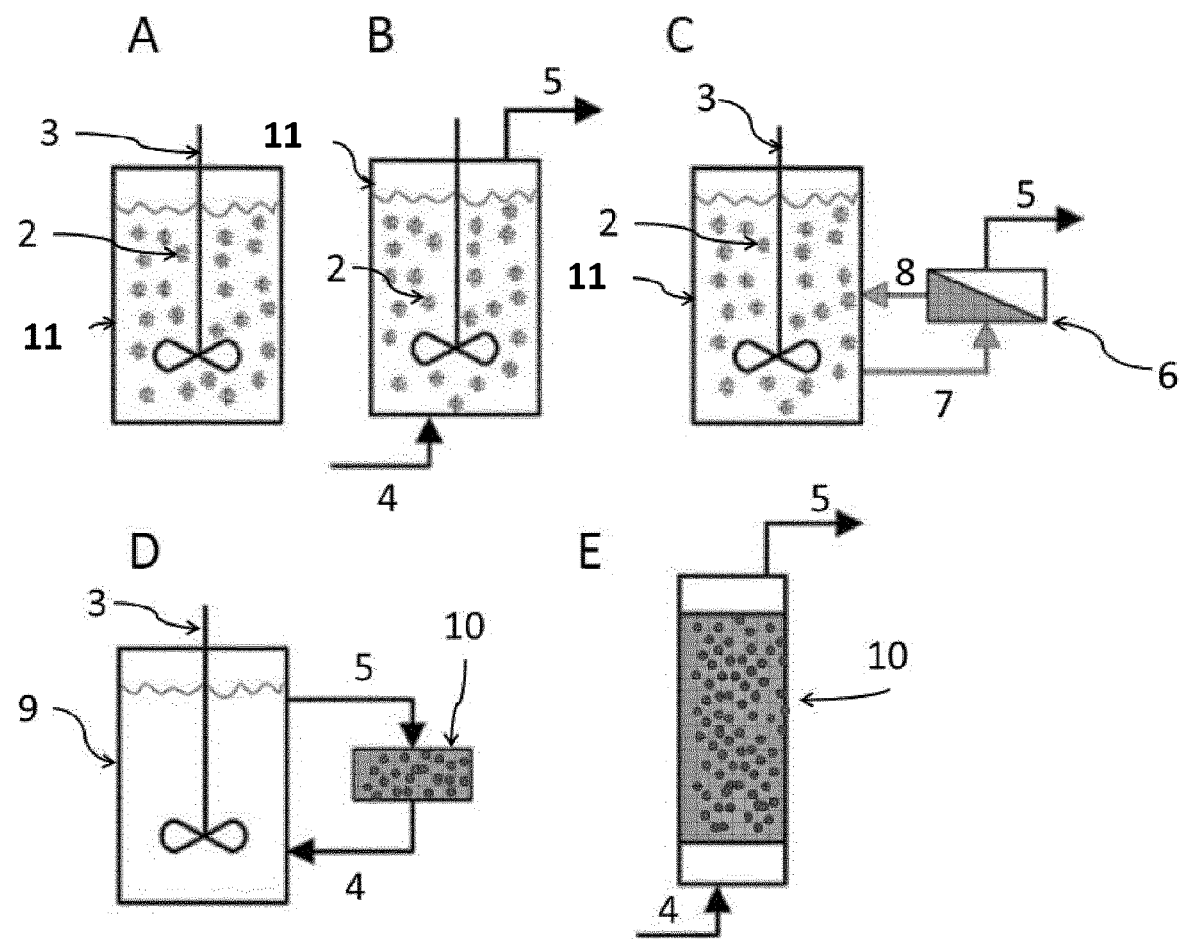
FIG. 3: Examples of different configurations for enzyme bioreactors containing immobilized PN/APs (A) Stirred-tank batch reactors, (B) Continuous (stirred-tank) batch reactors, (C) Stirred tank-ultrafiltration reactor, (D) Recirculation batch reactors, (E) Continuous packed bed reactors. Different components of the reactor types are indicated: (11) reactor vessel/reaction module, (2) immobilized enzyme, (3) stirrer, (4) inlet, (5) outlet, (6) ultrafiltration device (diagonal line: ultrafiltration membrane), (7) feed tube for ultrafiltration device, (8) recirculation tube, (9) substrate/buffer tank, (10) packed bed tank, containing enzymes. Figure adapted from (Illanes, Andrés, ed. *Enzyme biocatalysis: principles and applications*. Springer Science & Business Media, 2008).

Important reactor types that may be used for the present invention comprise, but are not limited to, variants of stirred-tank batch reactors, continuous stirred-tank batch reactors, recirculation batch reactors, stirred tank-ultrafiltration reactors, and continuous packed-bed reactors (Illanes, Andrés, ed. Enzyme biocatalysis: principles and applications. Springer Science & Business Media, 2008, chapter 5), FIG. 3.

All reactor types may additionally have heating/cooling devices, pressure devices, and the stirred reactors may contain elements to control the stirring efficiency. Moreover, some reactors may be connected to a filtration setup, comprising e.g. an ultrafiltration device.

An enzyme reactor (of any kind), including tubes, vessels and other parts (sensors), for use in the present invention may be made of glass or steel, such as stainless steel according to European standard EN 10088, for example 1.43XX, 1.44XX, 1.45XX, or else, depending on the pressure which is applied to the reaction. The material of the reaction vessel is also to be selected to have no binding of any of the reaction components to the walls of the vessel which may introduce a contamination to the following reaction. Further, the material should neither have any influence on the reaction itself, nor have a risk of leakage of hazardous chemicals (e.g., bisphenol A) or allergens (e.g., heavy metals). The material should also be selected to not be corrosive, such as stainless steel, or should in any way negatively influence the immobilization of the PNP/PAP of the invention.

Stirred-tank batch reactors (FIG. 3A) may consist of a tank or vessel containing a rotating stirrer. The vessel may be fitted with fixed baffles to improve the stirring efficiency in the vessel. The vessel may be loaded with the immobilized PNP/PAP in a respective reaction buffer, and the other reaction components. In such a reactor, the immobilized PNP/PAP and RNA molecules have identical residence times. After the enzymatic reaction occurred, and after emptying of the batch reactor, the immobilized PNA/P, the ATP and the poly(N/A) RNA molecules have to be separated. This can be done e.g. by a filter device or membrane with a pore size smaller than the size of the immobilized PNP/PAP and bigger than the size of the poly(N/A) RNA molecules. Alternatively, the separation may be performed via centrifugation, and ideally the immobilized PNP/PAP may be recycled for another reaction cycle. Alternatively, the reaction vessel comprises a device which allows the direct separation of the immobilized PNA/P from the other reaction components so that the PNP/PAP may stay in the reaction vessel.

A stirred-tank batch reactor is particularly preferred in the context of the present invention. In this context it is particularly preferred to use PNP/PAP immobilized to sepharose as solid support in the reaction vessel.

In another preferred embodiment, the enzyme reactor comprising the immobilized PNP/PAP is a continuous stirred-tank batch reactor.

Continuous stirred-tank batch reactors (FIG. 3B) may be constructed similar to stirred-tank batch reactors (see above, cf FIG. 3A) with the main difference that continuous in and out flow via inlet and outlet tubes may be applied. One feature of such a reactor type is that the immobilized PNP/PAP and the RNA molecules do not have identical residence times in the reactor. Reaction medium, composed of buffer, salts, nucleotides and RNA, may be pumped into the tank or vessel via an inlet that may be located at the bottom of the tank, and reaction buffer containing the poly(N/A) RNA molecules may be moved off via an outlet attached at the top.

Optionally, the poly(N/A) RNA molecules and other reaction components are constantly and repeatedly fed into the reactor vessel to have a good distribution of the reaction components which are not immobilized. Inlet and outlet flow may be controlled by a pumping device in such a way that the enzymatic reaction can occur. Moreover, outlet tubes may have molecular weight cut-off filters to avoid contamination of the product by immobilized PNP/PAP or the immobilized PNP/PAP may be immobilized on a net or a honeycomb like solid structure inside the reaction vessel. The outlet tube molecular weight cut-off filters may have a molecular weight cut-off in a range from 10 kDa to 500 MDa, preferably in a range from 50 kDa to 300 MDa, more preferably from 100 kDa to 100 MDa, even more preferably from 500 kDa to 50 MDa, and most preferably from 750 kDa to 25 MDa, such as 1 MDa. One advantage of such an embodiment is that the immobilized PNP/PAP does not have to be separated from the other reaction components, such as the poly(N/A) RNA molecules.

In another preferred embodiment, the enzyme reactor containing an immobilized PNP/PAP is a stirred tank ultrafiltration reactor.

A stirred tank-ultrafiltration reactor (FIG. 3 C) may be constructed similar to stirred-tank batch reactors (see above, cf. FIGS. 3 A and 3 B), with the major difference that a small ultrafiltration device is connected to the reaction vessel where the separation of product (poly(N/A) RNA) and immobilized PNA/P takes place. This separation may be facilitated via an ultrafiltration or diafiltration device. In ultrafiltration, the membranes comprise a discrete porous network. The mixed solution is pumped across the membrane, smaller molecules pass through the pores (ATP, RNA) while larger molecules (poly(N/A) RNA, immobilized PNP/PAP) are retained. Typical operating pressures for ultrafiltration are 1 to 10 bar. The retention properties of ultrafiltration membranes are expressed as molecular weight cut-off (MWCO). This value refers to the approximate molecular weight (MW) of a dilute globular solute (i.e., a typical protein) which is 90% retained by the membrane.

However, a molecule's shape can have a direct effect on its retention by a membrane. For example, elongated molecules such as RNA or polyN/A RNA molecules may find their way through pores that will retain a globular species of the same molecular weight (Latulippel and Zydney (2011) Journal of Colloid and Interface Science, 357(2), pages 548-553). Preferred in this context are membranes, e.g. cellulose membranes, having nominal molecular weight cut-offs in a range from 10 kDa to 500 MDa, preferably in a range from 50 kDa to 300 MDa, more preferably from 100 kDa to 100 MDa, even more preferably from 500 kDa to 50 MDa, and most preferably from 750 kDa to 25 MDa, such as 1 MDa.

Eventually, the immobilized PNP/PAP may be captured in the ultrafiltration device and returned back to the reaction chamber.

In another preferred embodiment the enzyme reactor comprising the immobilized PNP/PAP of the present invention is a recirculation batch reactor.

Recirculation batch reactors (FIG. 3 D) may comprise a first vessel, connected via inlet and outlet tubes to a second vessel. The first vessel is loaded with immobilized PNP/PAP. The second vessel contains the other reaction components. In such a recirculation batch reactor, the immobilized PNP/PAP is densely packed in the first vessel, or immobilized on a net or honeycomb like solid support through which water with the other reaction components is constantly circulating. After enzymatic reaction occurred, the reaction medium, that contains the reaction components including the poly(N/A) RNA molecules, can be emptied and used for separation of the poly(N/A) RNA molecules from the other reaction components, such as by filtration or chromatography. One advantage of such an embodiment is that the immobilized PNP/PAP does not have to be separated from the other components and in particular from the poly(N/A) RNA, by other means. Another advantage is that the reaction can be repeated (via circulating the product poly(N/A) RNA back into the reaction vessel) until the desired length of the poly(N/A) tail is achieved.

In another preferred embodiment, the enzyme reactor comprising an immobilized PNP/PAP is a continuous packed bed reactor.

Continuous packed bed reactors (FIG. 3 E) may consist of a vessel comprising PNP/PAP immobilized to a solid support. The container may be densely packed, thereby forming a bed containing the PNP/PAP immobilized to a solid support. One feature of such a reactor type is that the immobilized PNP/PAP and the RNA molecules do not have identical residence times in the reactor. Reaction medium, composed of the reaction components including nucleotides and RNA, may be pumped into the packed bed reactor via an inlet that may be located at the bottom of the tank, and reaction medium containing the poly(N/A) RNA product may be moved off via an outlet attached at the top of the tank. Inlet and outlet flow may be controlled by a pumping device in such a way that the enzymatic reaction can occur. Moreover, outlet tubes may have molecular weight cut-off filters to avoid contamination of the product by immobilized PNP/PAP. The outlet tube molecular weight cut-off filters may have a molecular weight cut-off in a range from 10 kDa to 500 MDa, preferably in a range from 50 kDa to 300 MDa, more preferably from 100 kDa to 100 MDa, even more preferably from 500 kDa to 50 MDa, and most preferably from 750 kDa to 25 MDa, such as 1 MDa. One advantage of such an embodiment is that the immobilized PNP/PAP does not have to be separated from the other reaction components by other means.

Optionally, the Enzyme Reactor (1) Comprises
a) a reaction module (11) for carrying out polyadenylation reactions; and optionally
c) a capture module (13) for temporarily capturing the poly(N/A) RNA;
d) a feed module (14) for controlling the in-feed of components of a reaction mix into the reaction module (11) and/or e) an (RNA) in vitro transcription (IVT) module (16) for the production of RNA template. The IVT module (16) and the feed module (14) may have a device for adjusting and controlling the temperature (12).

Furthermore, all components of the feed module (14) are optionally heated to reaction temperature (by a device for adjusting and controlling the temperature (12) or a heater (17)) during the feed-in flow via an inlet tube (4) to the enzyme reactor (1). A schematic drawing of one exemplary polyadenylation reactor is provided in FIG. 4.

According to a preferred embodiment of the present invention, the enzyme reactor (1) comprises f) at least one sensor unit (15). Data collection and analyses by the at least one sensor unit (15) allows the control of the integrated pump system (actuator) for repeated feeds of components of the reaction mix, e.g. buffer components or nucleotides (e.g., ATP).

According to a further preferred embodiment of the present invention, the enzyme reactor (1) operates in a semi-batch mode or in a continuous mode. The term semi-batch as used herein refers to the operation of the polyadenylation reaction as a repetitive series of reactions. For example, the reaction is allowed to proceed for a finite time at which point the product is removed, new reactants added, and the complete reaction repeated. The term continuous-flow as used herein refers to a reaction that is carried out continually in a bioreactor core with supplemental reactants constantly added through an input feed line and products constantly removed through an exit port. A continuous-flow reactor controls reagent delivery and product removal through controlled device flow rates, which is advantageous for reactions with reagent limitations and inhibitory products.

The reaction module further comprises a filtration membrane (6) to separate the produced poly(N/A) RNA from the reaction mix and to subsequently collect the poly(N/A) RNA in the capture module (13). The introduction of a filtration membrane in a flow system, for example an ultrafiltration membrane, is used for separation of high molecular weight components, such as e.g. immobilized or non-immobilized enzymes and/or polynucleotides. Such membranes typically have a molecular weight cut-off in a range from 10 kDa to 500 MDa, preferably in a range from 50 kDa to 300 MDa, more preferably from 100 kDa to 100 MDa, even more preferably from 500 kDa to 50 MDa, and most preferably from 750 kDa to 25 MDa, such as 1 MDa.

Suitable filtration membranes may consist of various materials known to a person skilled in the art (van de Merbel, 1999. J. Chromatogr. A 856(1-2):55-82). For example, membranes may consist of regenerated or modified cellulose or of synthetic materials. The latter include polysulfone (PSU), polyacrylo-nitrile (PAN), polymethyl-methacrylate (PMMA), mixtures of polyarylether-sulfones, polyvinyl-pyrrolidone and polyamide (Polyamix®, available from Gambro Dialysatoren, GmBH, Hechingen, Germany). For example, the polysulfones include polyether-sulfone (poly(oxy-1,4-10 phenylsulfonyl-1,4-phenyl), abbreviated PES). In some exemplary embodiments, polyethersulfone may be utilized as a semipermeable membrane for the use according to the disclosure. In some cases, PES membranes include increased hydrophilicity (and/or the improved wettability of the membrane with water) compared to PSU membranes. In some embodiments, the wettability of PES membranes can, for example, be further increased by the inclusion of the water-soluble polymer polyvinylpyrrolidone.

An important parameter that influences the flux of molecules across the filtration membrane is the pore size or pore-size distribution. A filtration membrane is usually characterized by its molecular weight cut-off (MWCO) value, i.e. a specific size limitation, which is defined as the molecular mass of the smallest compound, which is retained for more than 90%. For each application, a proper MWCO value needs to be selected so that high molecular weight compounds are sufficiently retained, but at the same time a rapid transport of the analyte is ensured. The filtration membrane of the filtration unit (6) may be an ultrafiltration membrane, and preferably has a molecular weight cut-off in a range from 10 kDa to 500 MDa, preferably in a range from 50 kDa to 300 MDa, more preferably from 100 kDa to 100 MDa, even more preferably from 500 kDa to 50 MDa, and most preferably from 750 kDa to 25 MDa. In a specific embodiment, the MWCO is 1 MDa. Optionally, the filtration membrane is selected from the group consisting of regenerated cellulose, modified cellulose, PES, PSU, PAN, PMMA, polyvinyl alcohol (PVA) and polyarylethersulfone (PAES).

The capture module (13) optionally comprises a resin (e.g., oligo d(T) resin), to capture the produced poly(N)RNA molecules and to separate the produced nucleic acid molecules from other soluble components of the reaction mix. Optionally, the capture module (13) comprises a sensor unit (15) to measure the concentration of the produced poly(N) RNA molecules means for purifying the captured produced poly(N)RNA and/or means for eluting the captured produced poly(N)RNA molecules, preferably by means of an elution buffer.

In a preferred embodiment, the reaction module (11) of the enzyme reactor (1) further comprises a reflux module (19) for optionally returning the filtrated reaction mix (comprising poly(A)RNA) to the reaction module (11) from the control module (18), whereas the control module (18) in between is able to distinguish between RNA with polyA lengths of N<120 nucleotides (nt) and N>120 nt. RNA with polyA lengths of N>120 nt are filled into the capture module via an outlet (5) whereas RNA with polyA lengths <120 nt are re-feeded to the enzyme batch reactor via the reflux module (19). In a specific embodiment, the reaction mix is re-entered into the reaction module (11) via the reflux module (19) until a desired poly(A) tail length is obtained.

In a preferred embodiment, the enzyme reactor further comprises several sensor units (15) which may be present at the reaction module (11), the capture module (13) and/or the feed modules (14 and 16). The sensor units (15) may be suitable for the real-time measurement of the concentration of separated nucleic acid molecules, the concentration of nucleoside triphosphates, and/or further reaction parameters, such as pH-value, reactant concentration, in- and out-flow, temperature and/or salinity, optionally, the sensor units measure the concentration of separated nucleic acids by photometric analysis.

The sensor units (15) may also measure further reaction parameters in the filtrated reaction mix, preferably wherein the further reaction parameters are pH-value and/or salinity.

According to some embodiments, the enzyme reactor, more specifically the one or more sensor units (15), comprises at least one ion-selective electrode, preferably for measuring the concentration of one or more types of ions in a liquid comprised in at least one compartment of the enzyme reactor, wherein the ion is preferably selected from the group consisting of $H^+$, $Na^+$, $K^+$, $Mg^{2+}$, $Ca^{2+}$, $Cl^-$ and $PO_4^{3-}$.

In the context of the present invention, the term "ion-selective electrode" relates to a transducer (e.g. a sensor) that converts the activity of a specific ion dissolved in a solution into an electrical potential, wherein the electrical potential may be measured, for instance, by using a volt meter or a pH meter. In particular, the term 'ion-selective electrode' as used herein comprises a system, which comprises or consists of a membrane having selective permeability, wherein the membrane typically separates two electrolytes. An ion-selective electrode as used herein typically comprises a sensing part, which preferably comprises a membrane having selective permeability and a reference electrode. The membrane is typically an ion-selective membrane, which is characterized by different permeabilities for different types of ions. Preferably, the at least one ion-selective electrode of the enzyme reactor comprises a membrane selected from the group consisting of a glass membrane, a solid state membrane, a liquid based membrane, and a compound membrane.

In preferred embodiments, the at least one ion-selective electrode comprises or consists of a system comprising a membrane, preferably a membrane as described herein, more preferably an electrochemical membrane, having different permeabilities for different types of ions, wherein the membrane, preferably a membrane as described herein, more preferably an electrochemical membrane, preferably separates two electrolytes. In one embodiment, the membrane comprises or consists of a layer of a solid electrolyte or an electrolyte solution in a solvent immiscible with water. The membrane is preferably in contact with an electrolyte solution on one or both sides. In a preferred embodiment, the ion-selective electrode comprises an internal reference electrode. Such internal reference electrode may be replaced in some embodiments, for example by a metal contact or by an insulator and a semiconductor layer. An ion-selective electrode permits highly sensitive, rapid, exact and non-destructive measurement of ion activities or ion concentrations in different media. Apart from direct measurements of ion activities or ion concentrations they can serve, in particular by using a calibration curve, for continuous monitoring of concentration changes, as elements for control of dosage of agents or as very accurate indicator electrodes in potentiometric titrations.

In preferred embodiments, the enzyme reactor comprises at least one ion-selective electrode, preferably as described herein, for measuring the concentration of one or more types of ions in at least one compartment of the enzyme reactor. For example, the at least one ion-selective electrode may be used to measure the concentration of one or more types of ions in a reaction module, a feed module (14) or a capture module (13) or the IVT module (16) of the reactor. Of course, it is possible to have one or more sensor units and ion-selective electrodes at the enzyme reactor, i.e. one or more or each of the capture module (13), the reaction module (11), the feed module (14), or the IVT module (16). Preferably, the at least one ion-selective electrode is used for measuring the concentration of one or more types of ions in the reaction module, more preferably in the reaction core or in the filtration compartment. Furthermore, the at least one ion-selective electrode may be comprised in a sensor unit of the enzyme reactor, preferably as defined herein. The one or more ion-selective electrodes may be located in the reaction module (11), the capture module (13), the feed modules (14) or the IVT module (16) of the enzyme reactor. In the context of the present invention, the phrase "the enzyme reactor comprises at least one ion-selective electrode" may thus refer to a situation, where the at least one ion-selective electrode is a part of the enzyme reactor, or to a situation, where the at least one ion-selective electrode is a separate physical entity with respect to the enzyme reactor, but which is used in connection with the enzyme reactor.

Preferably, the at least one ion-selective electrode is connected to a potentiometer, preferably a multi-channel potentiometer (for instance, a CITSens Ion Potentiometer 6-channel, high-20 resolution; C-CIT Sensors AG, Switzerland). In a preferred embodiment, the at least one ion-selective electrode is preferably a tube electrode, more preferably selected from the group consisting of a $Mg^2$ selective tube electrode, a $Na^+$ selective tube electrode, a $Cl^-$ selective tube electrode, a $PO_4^{3-}$ selective tube electrode, a pH-selective tube electrode and a $Ca^{2+}$ selective tube electrode, preferably used in connection with a potentiometer. Even more preferably, the enzyme reactor (1) comprises at least one ion-selective electrode, wherein the at least one ion-selective electrode is preferably selected from the group consisting of a CITSens Ion $Mg^{2+}$ selective mini-tube electrode, a CITSens Ion $Na^+$ selective mini-tube electrode, a CITSens Ion $Cl^-$ selective mini-tube electrode, a CITSens Ion $PO_4^{3-}$ selective mini-tube electrode, a CITSens Ion pH-selective mini-tube electrode and a CITSens Ion $Ca^{2+}$ selective mini-tube electrode (all from C-CIT Sensors AG, Switzerland), preferably in connection with a potentiometer, more preferably with a multi-channel potentiometer, such as a CITSens Ion Potentiometer 6-channel, high-resolution (C-CIT Sensors AG, Switzerland).

Ion-selective electrodes have numerous advantages for practical use. For example, they do not affect the tested solution, thus allowing non-destructive measurements. Furthermore, ion-selective electrodes are mobile, suitable for direct determinations as well as titration sensors, and cost effective. The major advantage of the use of an ion-selective electrode in an enzyme reactor (e.g. a polyadenylation reactor) is the possibility to measure in situ without sample collection and in a non-destructive manner.

The ion-selective electrodes allow very specifically to monitor the polyadenylation reaction, and in particular the reaction catalyzed by the immobilized poly(N/A)polymerase according to the invention.

The sensor units (15) may further be equipped for the analysis of critical process parameters, such as pH-value, conductivity and nucleotide concentration in the reaction mix. Preferably, the sensor unit of the polyadenylation reaction module (11) or the IVT module (16) comprises a sensor, such as an UV flow cell for UV 260/280 nm measurement, for the real-time measurement of the nucleotide concentration during the polyadenylation reaction. Preferably, the sensor of the sensor units measures the nucleotide concentration, as a process parameter, by photometric analysis.

In addition to the described online measurements of the sensor units (15), or in addition to the described online measurements of the control module (18), the same measurements may be performed in separate analysis modules (as at-line controls). E.g., the progress of the polyadenylation reaction may be analyzed at-line via gel electrophoresis, photometry etc.

Moreover, the enzyme reactor may be adapted to carry out the method as described herein and/or may comprise the PNP/PAP as described herein and/or may be suitable for the use described herein.

In a preferred embodiment, the enzyme reactor as described above additionally comprises a reaction unit for the simultaneous production of RNA from a DNA template via enzymatic RNA in vitro transcription.

In one embodiment, the RNA in vitro transcription takes place in an IVT reaction module (16), and the RNA molecules produced in the IVT reaction in the IVT reaction module (16) are introduced into the polyadenylation reaction module (11).

In one embodiment, the RNA in vitro transcription takes place in the same reaction module (11), in parallel to a polyadenylation reaction.

In embodiments where the polyadenylation reaction and the RNA in vitro reaction takes place in one enzyme reactor and/or in one reaction module (11), it is particularly preferred to use immobilized PNP/PAPs that are immobilized onto a solid support via thioether linkages (R—S—R) according to the present invention. Thioether linkages are particularly preferred in such an embodiment because common reaction buffers of RNA polymerases contain reducing agents (e.g., DTT), that may reduce disulfide bonds (which would cause an enzyme leakage) but do not reduce thioether linkages.

Further provided is a kit comprising a PNP/PAP characterized in that the PNP/PAP is immobilized onto a solid support, preferably the PNP/PAP is a microbial, preferably of bacterial origin, PNP/PAP or a PNP/PAP as described herein, and at least one buffer selected from the group consisting of reaction buffer, storage buffer and combinations thereof, including, e.g., nucleotides, salts etc.

In one embodiment of that aspect of the invention, the kit additionally comprises an RNA polymerase and a suitable buffer for RNA in vitro transcription.

In preferred embodiments of this aspect, the produced poly(N)RNA) according to the present invention may be used in gene therapy, (genetic) vaccination or immunotherapy.

EXAMPLES

The examples shown below are merely illustrative and shall describe the present invention in a further way. These examples shall not be construed to limit the present invention.

Example 1

Immobilization of *Escherichia coli* Poly(A)Polymerase I on Thiopropyl Sepharose 6B The goal of this experiment was to obtain stably immobilized and functional poly(A)polymerase (PAP). *Escherichia coli* PAP mutants were generated, mutant 1 (referred to as "mut1"), mutant 2 (referred to as "mut2") and mutant 3 (referred to as "mut3") and characterized for enzymatic activity. As immobilization strategy, immobilization onto Thiopropyl Sepharose 6B solid supports was tested. The reaction conditions, respectively the pH, were chosen as such the formation of disulfide linkages (R—S—S—R) via sulfhydryl groups (—SH) via cysteine residues present on the PAP mutant proteins was promoted.

The obtained immobilized PAP mutants were further characterized and tested for enzymatic activity (i.e. their polyadenylation activity), and stability (see Example 2-3) and also used in a polyadenylation reactor (see Example 4). A detailed description of the immobilization procedure and a discussion of the results are provided below.

1.1 Design of *Escherichia coli* PAP mut1 and mut2 and mut3 Proteins

The three PAP mutants (mut1, according to SEQ ID NO: 140; mut2, according to SEQ ID NO: 113; mut3, according to SEQ ID NO: 203) were generated by c-LEcta (codon optimization, gene synthesis, sub cloning, protein expression, protein purification via a C-terminal 6H-tag). All mutant enzymes were engineered to comprise a C-terminal extension comprising a flexible linker element ((G4S)2) and an oligohistidine purification tag (6H-tag, HIS-tag) and a C-terminal-most cysteine residue allowing for a stable and functional coupling of the proteins to Thiopropyl Sepharose 6B solid supports. In addition, the sequence of the mut2 enzyme was changed in a way that all natural cysteine residues were substituted with alanine residues (C88A, C256A, C346A). The sequence of the mut3 enzyme was changed after BLAST analysis of the *E. coli* PAP wild type sequence against a non-redundant database to identify possible amino acid substitutions. The most common substitutions were applied to all natural cysteine leading to following substitutions: C88S, C256R, C346A. The protein design of mut2 and mut3 was chosen to allow for a directed way of immobilization, exclusively facilitated via the C-terminal-most cysteine residue.

1.2 Initial Activity Characterization of Engineered Mutant PAP Proteins

To characterize the enzymatic activity of the engineered mutant PAP enzymes mut1, mut2 and mut3, a poly(A) polymerase tailing assay using a 60 nucleotide long RNA (according to SEQ ID NO: 202; synthesized by Biomers, Ulm, Germany, HPLC-PAGE) as RNA template was performed. 1 µg template RNA was incubated with ATP and mutant PAP enzymes for 1 h at 37° C. in tailing buffer (from A-Plus Poly(A) Polymerase Tailing Kit, Biozym Scientific GmbH, Hessisch Oldendorf, Germany; +1 mM ATP, 2 U Ribolock™, Thermo Fisher Scientific, Waltham, Mass., USA) followed by heat-inactivation at 80° C. for 5 minutes and storage on ice. Next, the RNA was purified using the following procedure: 18 µL RNA sample, 2 µL WFI, 36 µL AmpureXP beads (Agencourt, Beckman Coulter, Brea, Calif., USA) and 27 µl isopropanol were mixed and incubated for 10 minutes at room temperature. The sample was placed on a magnet plate for 5 minutes until the solution turned completely clear to separate the magnetic beads. The RNA bound beads were washed two times with freshly-made 85% ethanol. The beads were air dried for 5 minutes and RNA was eluted with 20 µL Tris/EDTA (TE) buffer. The RNA content of the respective samples was measured photometrically (see FIG. 5).

1.3 Re-Buffering of Recombinant *Escherichia coli* PAP mut1 and mut2 Proteins

The obtained purified recombinant PAP mut1 and mut2 proteins were reconstituted in storage buffer (50 mM Tris-HCl, 500 mM NaCl, 1 mM EDTA, 0.1% Triton® X-100, pH 7.5). For immobilization experiments, recombinant PAP mut1 and mut2 proteins were re-buffered in immobilization buffer (100 mM $K_2HPO_4$—$KH_2PO_4$, pH 7.5, 500 mM NaCl, 1 mM EDTA) using Vivaspin-20 (10 kDa molecular weight cutoff (MWCO); Sartorius, Gottingen, Germany) columns to obtain a final protein concentration of 700 ng/µL. SDS-PAGE and subsequent Coomassie Blue staining were performed according to standard protocols known in the art to analyze the integrity of PAP mutants mut1 and mut2 (see FIG. 5). The obtained re-buffered PAP mutants mut1 and mut2 were used in immobilization experiments (see below).

1.4 Re-Buffering of Thiopropyl Sepharose 6B

After swelling of 0.85 g freeze-dried Thiopropyl Sepharose 6B beads (GE Healthcare, Chicago, USA, 17-0420-01) in water for injection (WFI) and subsequent pelletizing, Thiopropyl Sepharose 6B beads were filled up to 6.8 g with WFI. For immobilization experiments, the beads were thoroughly washed with immobilization buffer, pelletized, and supernatant was discarded. The obtained re-buffered beads were used in immobilization experiments (see below).

1.5 Immobilization Procedure 0.1 mg recombinant re-buffered PAP mut1 and mut2 were transferred in immobilization buffer comprising re-buffered Thiopropyl Sepharose 6B beads (referred to as "TS") and rotated for 1 h at room temperature to allow immobilization. The immobilized PAP mutants (referred to as "PAP-TS mut1" and "PAP-TS mut2") were pelletized and the supernatant was stored at 4-8° C. PAP-TS mutants were thoroughly washed with storage buffer and stored in storage buffer at 4-8° C. SDS-PAGE and subsequent Coomassie Blue staining were performed to analyze the immobilization efficiency of PAP mutants to the beads. A photograph of the respective gels is provided in FIG. 6.

1.6 Results and Discussion

Figure 5:
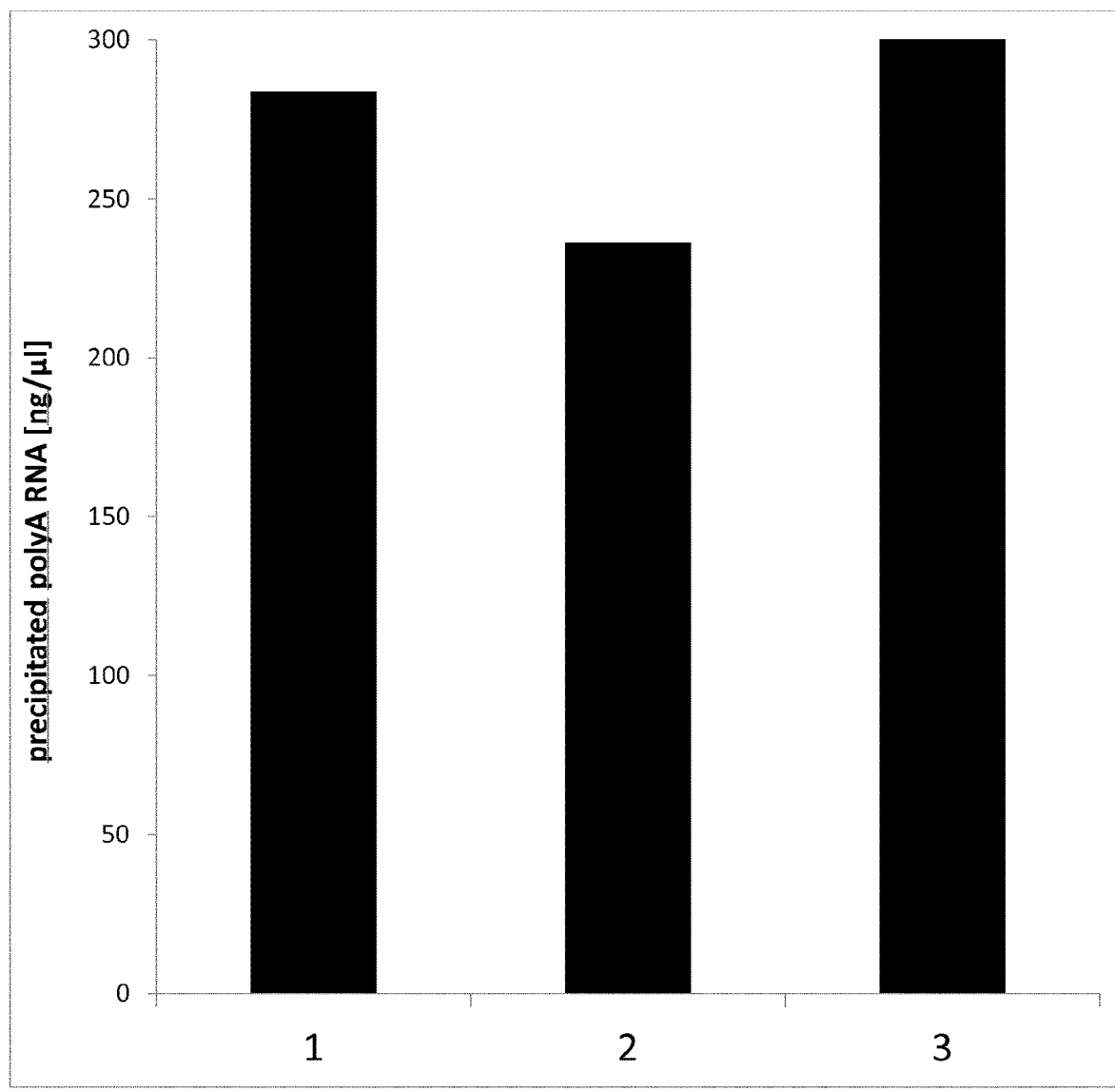
FIG. 5: Activity characterization of engineered *E. coli* PAP mutants. This Figure shows the produced poly(A)RNA after performing a polyadenylation reaction on a small RNA template (60 nucleotides). The data shows that all three mutant PAPs (1: mut1; 2: mut2; 3: mut3) are enzymatically active in solution. A detailed description of the experiment is provided in the example section, Example 1.

As shown in FIG. 5, all three engineered PAP mutant proteins (mut1, mut2, mut3) show a comparable enzymatic polyadenylation activity, because a comparable amount of polyadenylated RNA was generated. The data suggests that all engineered mutant *E. coli* PAP proteins are active in solution. The data also implies that the cysteine residues C88, C256 and C346 are not crucial for the activity of the enzyme (in mut2 and mut3 these cysteines have been substituted with other amino acids). Moreover, the data shows that the addition of a C-terminal element comprising a linker, a HIS-tag and a C-terminal most cysteine does not impede enzymatic activity. These results suggest that the inventive engineering of *E. coli* PAP may be broadly transferrable to generate other functional PAP mutants of bacterial origin in general, e.g. PAP mutants according to SEQ ID Nos: 16-22, 24-112, 114-139, 141-155).

Figure 6:
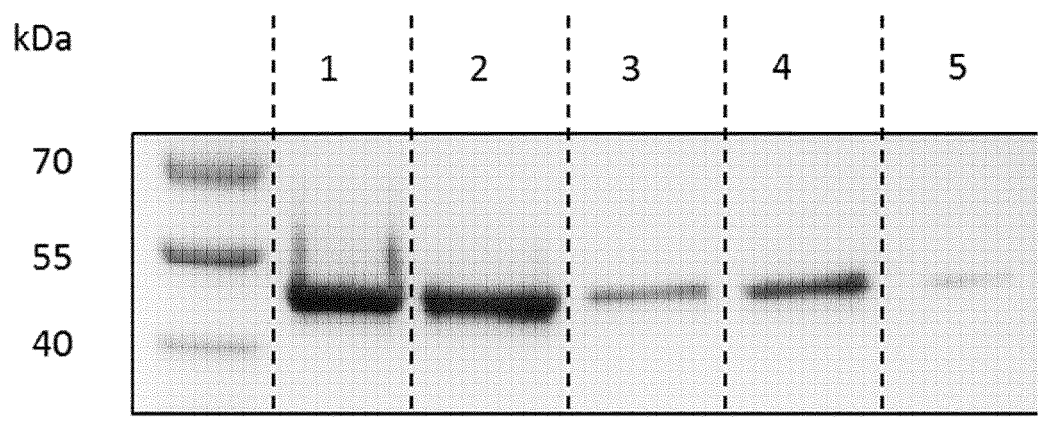
FIG. 6: SDS-PAGE and Coomassie Blue staining of recombinant PAP mut1 (A) and mut2 (B) proteins. After re-buffering in immobilization buffer, recombinant PAP mut1 and mut2 were efficiently immobilized using Thiopropyl Sepharose 6B (TS) solid supports. (A) Line 1: PAP mut1; line 2: re-buffered PAP mut1; line 3: irrelevant sample; line 4: PAP-TS mut1; line 5: irrelevant sample. (B) Line 1: PAP mut2; line 2: re-buffered PAP mut2; line 3: irrelevant sample; line 4: PAP-TS mut2. A detailed description of the experiment is provided in the example section, Example 1.
Figure 6:
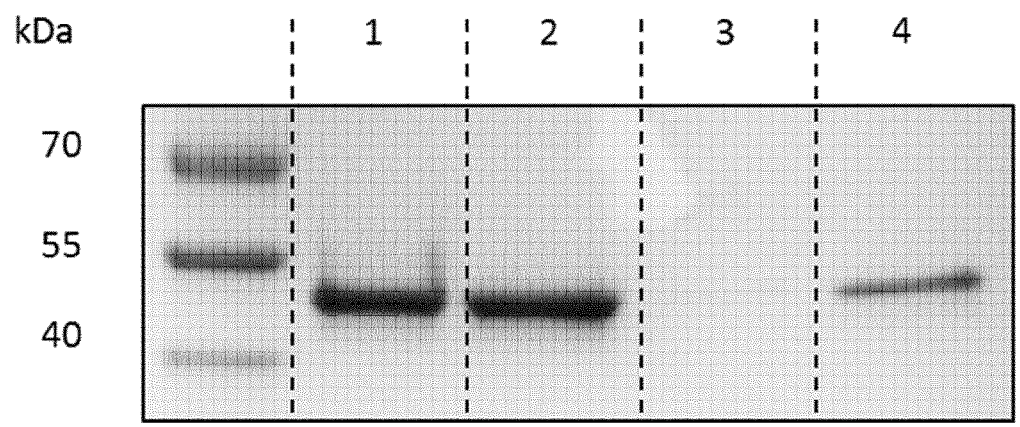

As shown in FIG. 6, the engineered and purified *E. coli* PAP mutant proteins mut1 and mut2 show the expected band size of approximately 55 kDa (see FIGS. 6 (A) and (B), line 1, respectively). Moreover, the buffer chosen for immobilization did not affect the integrity of the respective proteins (see FIGS. 6 (A) and (B), line 2, respectively).

In addition, the inventors demonstrate that the engineered PAP mutant proteins mut1 and mut2 were successfully immobilized on the chosen solid support. For interpretation of the results, it has to be emphasized, that under reducing conditions of the SDS PAGE, the disulfide linkage between the solid support and the PAP mutant proteins gets reduced, and consequently, the occurrence of a band at 55 kDa is a marker for successful protein immobilization (see FIGS. 6 (A) and (B), line 4, respectively).

In summary, the results show that the immobilization strategy using the inventive engineered PAP mutants works, suggesting that immobilization using other *E. coli* PAP mutants comprising a linker element would also work (e.g., according to SEQ ID NOs: 18, 58-112, 114-139). In addition, the inventive engineering of the *E. coli* PAP enzymes may also be transferred to other PAP enzymes, e.g. to PAPs derived from *Meiothermus silvanus* or *Thermus aquaticus* (e.g., according to SEQ ID NOs: 20, 22, 143-155). It has to be noted, that other linker elements known in the art may be used for the engineering of mutant PAP proteins (e.g., linkers according to SEQ ID NOs: 156-180).

Example 2

Long-Term Activity Tests of Immobilized PAP-TS mut2

2.1 Experimental Procedure

The immobilized PAP-TS mut2 ("TS" denotes immobilization onto Thiopropyl Sepharose 6B) (obtained according to Example 1) was further tested for its enzymatic activity in a poly(A)polymerase tailing assay using a 60 nucleotide long model RNA (according to SEQ ID: 202; synthesized by Biomers, Ulm, Germany, HPLC-PAGE) as RNA template was performed. 1 µg RNA template was incubated with ATP and PAP-TS mut2 or the respective soluble PAP mut2 for 1 h at 37° C. in tailing buffer (from A-Plus™Poly(A) Polymerase Tailing Kit, Biozym Scientific GmbH, Hessisch Oldendorf, Germany; +1 mM ATP, 2 U Ribolock™, Thermo Fisher Scientific, Waltham, Mass., USA) followed by heat-inactivation at 80° C. for 5 minutes and storage on ice. The polyadenylated RNA was analyzed on a 15% TBE-UREA PAGE and subsequently stained with Sybr® Gold (Thermo Fisher Scientific, Waltham, Mass., USA) to assess the polyadenylation activity of PAP mut2.

To test the stability and long-term activity of immobilized PAP mut2, PAP-TS mut2 was stored at 4° C. and poly(A) polymerase tailing assays were performed after 5, 14 and 22 days. The results were compared to mut2 which was not immobilized. The results are shown in FIG. 7.

2.2 Results and Discussion

Figure 7:
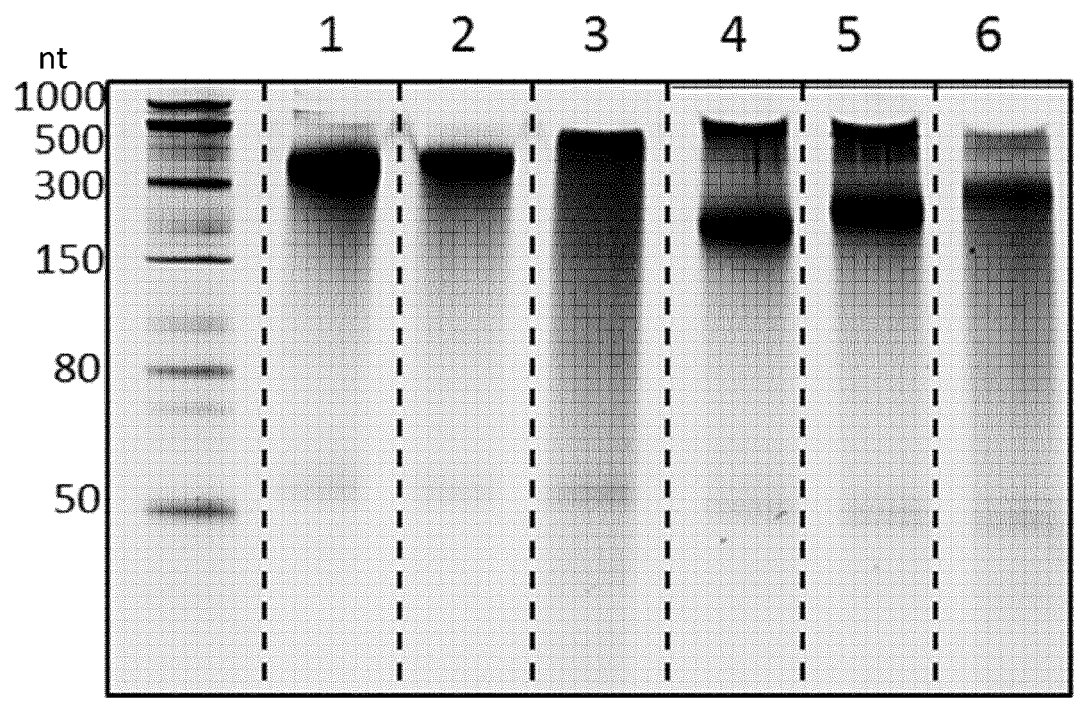
FIG. 7: Immobilized PAP mut2 protein (PAP-TS mut2) maintains long-term activity. Polyadenylation activity of PAP-TS mut2 was monitored and compared to the activity of the respective soluble mutant enzyme mut2. Poly(A)polymerase tailing assays were performed after storage of the respective enzymes at 4° C. for 5, 14 and 22 days. The Figure shows the result for PAP mut2 (soluble: lanes 1-3, immobilized: lanes 4-6) after storage of the enzyme for 5 days (lane 1 and 4), 14 days (lane 2 and 5), and 22 days (lane 3 and 6). A detailed description of the experiment is provided in the example section, Example 2. nt=number of nucleotides.

As shown in FIG. 7, both PAP mut2 and PAP-TS mut2 showed a comparable good enzymatic activity (see FIG. 7), indicated by the extension/elongation of the RNA from 60 nucleotides to approximately 500 nucleotides.

In addition, the PAP-TS mut2 showed a noticeable increased long term activity compared to the soluble mut2 enzyme.

In summary, the results clearly show that for a functional immobilization of *E. coli* PAP, the substitution of the naturally occurring cysteine residues to alanine (C88A, C256A, C346A) is possible and does not lead to a loss in enzymatic activity thereby allowing for a directed immobilization of the PAP mut2 protein via its C-terminally-most cysteine residue. The data also indicates that a long-term stability and long-term enzymatic activity for the immobilized mut2 protein was achieved (PAP-TS mut2). Consequently, PAP-TS mut2 beads are suitable for a repetitive use in polyadenylation reactions. Accordingly, PAP-TS mut2 beads may be applied in polyadenylation reactors according to the present invention (cf. Example 4).

It has to be noted that the finding of the present example are also expected to be transferrable to other PAPs, e.g. to other PAP mutants derived from *E. coli* where the natural cysteines have been substituted to serine and/or valine and/or alanine to comprise only one cysteine residue (according to SEQ ID NOs: 16-18, 24-83, 85-111, 113-139) or to PAP mutants derived from other bacteria, such as *Meiothermus silvanus* or *Thermus aquaticus* that only comprise one cysteine residue (e.g., according to SEQ ID NOs: 19-22, 141-144, 146-148, 150-152, 154-155). In general, this immobilization strategy (via a —SH group of only one cysteine) allows for a site-directed way of immobilization (e.g., via thiol activated supports, maleimide activated supports, epoxy activated supports, etc.) and ensures flexibility of the PAP enzyme which is fundamentally important for enzymatic activity of the protein.

Example 3

Heat-Stability and Activity Tests of Immobilized PAP-TS mut2

3.1 Experimental Procedure

To further characterize the stability and activity of immobilized mutant protein mut2 (PAP-TS mut2; obtained according to Example 1), the soluble protein PAP mut2 and the immobilized protein PAP-TS mut2 that were stored at 4° C. for 22 days (cf. Example 2) were additionally subjected to heat stress for up to 180 minutes at 37° C. in tailing assay buffer. Subsequently, heat stressed PAP mut2 and PAP-TS mut2 were characterized for enzymatic activity in a poly(A) polymerase tailing assay (performed according to Example 2); the tailing reaction was started through addition of the RNA template and ATP. The results of the experiment are shown in FIG. 8.

Figure 8:
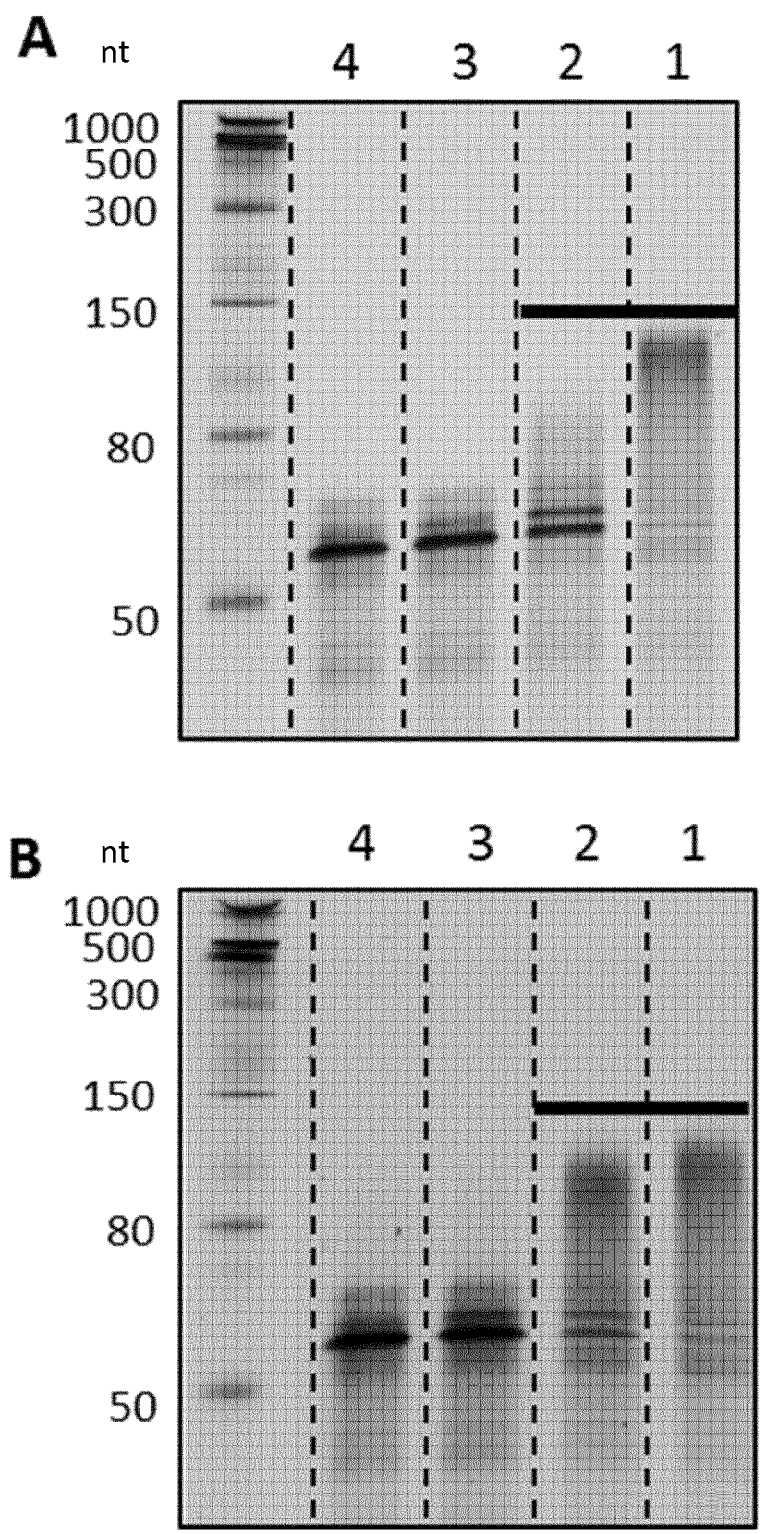
FIG. 8: Immobilized PAP-TS mut2 shows improved heat stability.

3.2 Results and Discussion:

As shown in FIG. 8, a noticeable increased heat-stability was observed for immobilized PAP-TS mut2 compared to the soluble mut2. The immobilized PAP-TS mut2 does not show a decrease in polyadenylation activity after heat stress for 30 minutes, whereas the soluble mut2 shows a substantial decrease in enzymatic activity after heat stress for 30 minutes (see FIG. 8, lanes 1 and 2, indicated by a horizontal bar). The data suggest that immobilization of mut2 to a solid support improves heat stability. An improved heat-stability of PAP-TS mut2 beads may be advantageous for long-lasting reactions in a polyadenylation reactor according to the present invention (cf. Example 4). These findings may be broadly transferrable to other immobilized PAP enzymes according to the present invention.

Example 4

Use of PAP-TS mut2 Beads in a Polyadenylation Reactor

The PAP-TS mut2 beads obtained according to Example 1 were used in a small-scale polyadenylation reactor to test the reusability of the PAP-TS mut2 beads (see section 4.1). Moreover, the prototype polyadenylation reactor was used for a controlled RNA polyadenylation reaction, resulting in poly(A)RNA products with defined poly(A)tail length, through a repetitive ATP feeds (see section 4.2).

A schematic drawing of the reactor used for that specific example is provided in FIG. 9. The reactor essentially consists of a reaction module (11) where the polyadenylation reaction occurs, a feed module (14). The enzyme reactor additionally comprises a filtration unit (6) and a capture module (13) where the produced polyadenylated RNA (23) can be collected (23). Buffer components (e.g. ATP) as well as the produced polyadenylated RNA can be re-injected into the reaction chamber (11) via an inlet tube comprising an inlet tube (4) in the form of an injection device.

4.1 Test of Reusability of PAP-TS mut2 Beads in the Polyadenylation Reactor

PAP-TS mut2 beads as well as tailing buffer (from A-Plus™ Poly(A) Polymerase Tailing Kit, Biozym Scientific GmbH, Hessisch Oldendorf, Germany)+1 mM ATP+2 U Ribolock™ (Thermo Fisher Scientific, Waltham, Mass., USA) and RNA template (SEQ ID NO: 202) were introduced into a Vivaspin® 500 column (MWCO 1 MDa, Sartorius, Göttingen, Germany) and incubated at 37° C. in 10 min intervals (for 0, 10, 20 and 60 minutes total incubation time). After each incubation step, the reactions were centrifuged (3000 g) and the buffer as well as the RNA template was reused and re-introduced into the reaction chamber. Additionally, samples from the flow-through were stored on ice for further analysis. The polyadenylated RNA as well as the flow-through samples were analyzed on a 15% TBE-UREA PAGE and subsequently stained with Sybr® Gold (Thermo Fisher Scientific, Waltham, Mass., USA) to assess the polyadenylation of the RNA. The result of the experiment is shown in FIG. 10.

4.2. Production of a Defined polyA Tail Length by Controlled ATP Feed into the Enzyme Reactor To generate polyadenylated RNA with a defined polyA tail length, PAP-TS mut2 beads as well as tailing buffer (from A-Plus™Poly(A) Polymerase Tailing Kit, Biozym Scientific GmbH, Hessisch Oldendorf, Germany)+2 U Ribolock™, Thermo Fisher Scientific, Waltham, Mass., USA, +50 μM ATP were introduced in Vivaspin® 500 column (MWCO 1 MDa, Sartorius, Göttingen, Germany) and incubated at 37° C. for several 10 minutes cycles (up to a total incubation time of 50 minutes). After each incubation cycle, the reactions were centrifuged and the flow-through was stored on ice for further analysis. Afterwards, additional 50 μM ATP was re-introduced into the reaction chamber and the reaction was incubated again. The end-product as well as the flow-through samples were analyzed on a 15% TBE-UREA PAGE and subsequently stained with Sybr® Gold (Thermo Fisher Scientific, Waltham, Mass., USA) to assess the polyadenylation of the RNA. PolyA tail lengths were estimated in comparison to a low range ssRNA Ladder (New England BioLabs Inc.). The result of the experiment is shown in FIG. 11.

4.3 Results and Discussion

FIG. 10 shows that the PAP-TS mut2 beads can be used in repetitive manner. After re-adding of the buffer components (including the poly(A)RNA) to the immobilized PAP-TS mut2, the poly(A)tail length of the RNA could be further extended. This feature is particularly important in the context of an enzyme reactor according to the present invention. It has to be emphasized that the PAP-TS mut2 beads are enzymatically active even after several centrifugation steps.

FIG. 11 shows that the PAP-TS mut2 beads used in an enzyme reactor according to FIG. 9 can be used to generate polyadenylated RNA of a defined length. In the present experimental setup, 50 μM ATP was feeded (introduced via injection) into the reaction chamber until the desired poly (A)tail length of 200 nt was obtained. In this setup, a linear elongation of the poly(A)tail was observed over time (approximately 25 adenosines in 10 minutes). Using the inventive PAP-TS mut2 beads in an enzyme reactor setting according to the present invention enables for the controlled production of polyadenylated RNA with defined poly(A) tails.

Summarizing the above, the results show that immobilized PAP-TS mut2 is well suitable for the use in an enzyme reactor and for repeated use. Clearly, these results may be transferred to other enzyme reactor settings and configurations according to the present invention (cf. FIGS. 2-4).

Example 5

Preparation of RNA 5.1 Preparation of DNA and RNA Constructs

For the present example, a DNA sequence encoding the hemagglutinin (HA) protein of influenza A virus (A/Netherlands/602/2009(H1N1)) is prepared and used for subsequent in vitro RNA transcription reactions.

According to a first preparation, the DNA sequence coding for the above mentioned mRNA is prepared. The construct 82564 (SEQ ID NO: 23) is prepared by introducing a 5'-TOP-UTR derived from the ribosomal protein 32L4, modifying the wild type coding sequence by introducing a GC-optimized sequence for stabilization, followed by a stabilizing sequence derived from the albumin-3'-UTR, a stretch of 64 adenosines (poly(A)-sequence), a stretch of 30 cytosines (poly(C)-sequence), and a histone stem loop. In SEQ ID NO: 23 the sequence of the corresponding mRNA is shown.

5.2 In Vitro Transcription

The respective DNA plasmid prepared according to section 1 above is transcribed in vitro using T7 polymerase. Subsequently the RNA is purified using PureMessenger® (CureVac, Tubingen, Germany).

Example 6

*Escherichia coli* pcnB (C88A, C256A, SEQ ID NO: 16) Immobilized on Thiol Sepharose 4B 6.1 Reconstitution of Recombinant pcnB 3 mg purified recombinant pcnB mutant (C88A, C256A) protein (custom-order from Genscript, Piscataway, N.J., USA) is reconstituted directly in 10 ml coupling buffer (0.1 M Tris-HCl pH 7.5, 0.5 M NaCl, 1 mM EDTA, in de-gassed $ddH_2O$) to obtain a final concentration of 300 μg/ml. The enzyme solution could then be used for coupling to Thiol Sepharose 4B (GE Healthcare, Piscataway, N.J., USA).

6.2 Column Preparation with Thiol Sepharose 4B

First, 3 g freeze-dried Thiol Sepharose 4B is suspended in 20 ml $ddH_2O$ and gently added to a 20 ml chromatography column. After washing the resin 10 times with 20 ml $ddH_2O$, the bottom of the column is closed and the Thiol Sepharose resin is equilibrated with 10 ml buffer for 10 minutes. After flow-through of the coupling buffer, the column is closed and 10 ml of enzyme solution is added. The coupling of pcnB to the resin is allowed to take place for 2 h at room temperature. After coupling, the column is washed with 15 ml reaction buffer. The flow through is analyzed for trace protein after washing steps using a NanoDrop™ (280 nm, ThermoScientific, Wilmington, Del., USA). Next, excess reactive sites are blocked by incubating the Thiol Sepharose resin in 10 ml 50 mM cysteine for 30 min. Following that, weakly bound proteins are removed by three washes with 25 ml coupling buffer.

6.3 Poly(A) Tailing (150 bases) of in Vitro Transcribed RNA Using the Enzyme Reactor Next, the resin is equilibrated with 15 ml reaction buffer (50 μM Tris-HCl pH 8.0, 0.25M NaCl, 10 μM $MgCl_2$, in de-gassed $ddH_2O$) for 10 minutes. After flow through of the buffer, 10 ml purified in vitro transcribed 82564 RNA (50 mg, corresponding to 75 pmol) in reaction buffer containing 0.045 μM ATP is added and incubated for 30 minutes at 37° C. Flow through containing the poly(A)-tailed R2564 RNA, is subjected to ultrafiltration methods to remove buffer components and to replace it with ultra-pure $ddH_2O$. Afterwards, poly(A) RNA is subjected to quality and integrity measurements. The majority of RNA molecules have a tail length of 150 bases.

6.4 Cleaning and Re-Use of the Linearization Reactor

After the polyadenylation reaction occurred, the enzyme reactor is washed several times with coupling buffer. Following that, a new RNA template can be loaded on the reactor. Alternatively, the reactor can be stored at 4° C. for several weeks.

Example 7

*Thermus aquaticus* pcnB (SEQ ID NO: 2) Immobilized on Thiol Sepharose 4B 7.1 Reconstitution of Recombinant pcnB 3 mg purified recombinant wildtype/native PcnB Thermus aquaticus protein (custom-order from Genscript, Piscataway, N.J., USA) is reconstituted directly in 10 ml coupling buffer (μ0.1 M Tris-HCl pH 7.5, 0.5 M NaCl, 1 mM EDTA, in de-gassed $ddH_2O$) to obtain a final concentration of 300 μg/ml. The enzyme solution could then be used for coupling to Thiol Sepharose 4B (GE Healthcare, Chalfont St Giles, UK).

7.2 Column Preparation with Thiol Sepharose 4B

First, 3 g freeze-dried Thiol Sepharose 4B is suspended in 20 ml $ddH_2O$ and gently added to a 20 ml chromatography column. After washing the resin 10 times with 20 ml $ddH_2O$, the bottom of the column is closed and the Thiol Sepharose resin is equilibrated with 10 ml buffer for 10 minutes. After flow-through of the coupling buffer, the column is closed and 10 ml of enzyme solution is added. The coupling of PcnB to the resin is allowed to take place for 2 h at room temperature. After coupling, the column is washed with 15 ml reaction buffer. The flow through is analyzed for trace protein after washing steps using a NanoDrop™ (280 nm, ThermoScientific, Wilmington, Del., USA). Next, excess reactive sites are blocked by incubating the Thiol Sepharose resin in 10 ml 50 mM cysteine for 30 min. Following that, weakly bound proteins are removed by three washes with 10 ml 1 M NaCl and three additional washes with 25 ml coupling buffer.

7.3 Poly-A-Tailing (200 bases) of in Vitro Transcribed RNA Using the Tailing Reactor Next, the resin is equilibrated with 15 ml reaction buffer (50 µM Tris-HCl pH 8.0, 0.25 M NaCL, 10 µM MgCl$_2$, in de-gassed ddH$_2$O) for 10 minutes. After flow through of the buffer, 10 ml purified in vitro transcribed R5264 RNA (50 mg, corresponding to 75 pmol) in reaction buffer containing 0.06 µM ATP is added and incubated for 45 minutes at 50° C. Flow through containing the poly(A)-tailed R5264 RNA, is subjected to ultrafiltration methods to remove buffer components and to replace it with ultra-pure ddH$_2$O. Afterwards, tailed RNA is subjected to quality and integrity measurements. The majority of RNA molecules have poly (A)-tail-length of 200 bases.

7.4 Cleaning and Re-Use of the Linearization Reactor

After tailing reaction occurred, the tailing reactor is washed several times with coupling buffer. Following that, a new RNA template can be loaded on the reactor. Alternatively, the reactor can be stored at 4° C. for several weeks.

Example 8

*Meiothermus silvanus* pcnB (436 (6xG)C) Immobilized on Thiol Sepharose 4B (SEQ ID NO: 22)

8.1 Reconstitution of Recombinant pcnB 3 mg purified recombinant wildtype PcnB *Meiothermus silvanus* mutant protein (custom-order from Genscript, Piscataway, N.J., USA) is reconstituted directly in 10 ml coupling buffer (µ0.1 M Tris-HCl pH 7.5, 0.5 M NaCl, 1 mM EDTA, in de-gassed ddH$_2$O) to obtain a final concentration of 300 µg/ml. The enzyme solution could then be used for coupling to Thiol Sepharose 4B (GE Healthcare, Chalfont St Giles, UK).

8.2 Column Preparation with Thiol Sepharose 4B

First, 3 g freeze-dried Thiol Sepharose 4B is suspended in 20 ml ddH$_2$O and gently added to a 20 ml column. After washing the resin 10 times with 20 ml ddH$_2$O, the bottom of the column is closed and the Thiol Sepharose resin is equilibrated with 10 ml buffer for 10 minutes. After flow-through of the coupling buffer, the column is closed and 10 ml of enzyme solution is added. The coupling of PcnB to the resin is allowed to take place for 2 h at room temperature. After coupling, the column is washed with 15 ml reaction buffer. The flow through is analyzed for trace protein after washing steps using a NanoDrop™ (280 nm, ThermoScientific, Wilmington, Del., USA). Next, excess reactive sites are blocked by incubating the Thiol Sepharose resin in 10 ml 50 mM cysteine for 30 min. Following that, weakly bound proteins are removed by three washes with 10 ml 1 M NaCl and three additional washes with 25 ml coupling buffer.

8.3 Poly-A-Tailing (400 bases) of in Vitro Transcribed RNA Using the Tailing Reactor Next, the resin is equilibrated with 15 ml reaction buffer (50 µM Tris-HCl pH 8.0, 0.25 M NaCl, 10 µM MgCl$_2$, in de-gassed ddH$_2$O) for 10 minutes. After flow through of the buffer, 10 ml purified in vitro transcribed R5264 RNA (50 mg, corresponding to 75 pmol) in reaction buffer containing 0.12 µM ATP is added and incubated for 45 minutes at 50° C. Flow through containing the poly(A)-tailed R5264 RNA, is subjected to ultrafiltration methods to remove buffer components and to replace it with ultra-pure ddH$_2$O. Afterwards, tailed RNA is subjected to quality and integrity measurements. The majority of RNA molecules are expected to have a tail-size of 400 bases.

8.4 Cleaning and Re-Use of the Linearization Reactor

After tailing reaction occurred, the tailing reactor is washed several times with coupling buffer. Following that, a new RNA template can be loaded on the reactor. Alternatively, the reactor can be stored at 4° C. for several weeks.

SEQUENCE LISTING (203 sequences)

SEQ ID NO: 1 - protein, 454 aa, Escherichia coli
MLSREESEAEQAVARPQVTVIPREQHAISRKDISENALKVMYRLNKAGYEAWLVGGGVRDLLLGKKPKDFDVTTNATPEQVRKLFRNCRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLCEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 2 - protein, 438 aa, Thermus aquaticus
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLCKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPG

SEQ ID NO: 3 - protein, 435 aa, Meiothermus silvanus
MLVAIRRVHLSPFPFPAQGYLVGGAVRDLMLGKRPKDLDFVVPNPEEAARDLAHRLGGSIFPLDEKRRFWRVVAPGTTYDYAPMPQGLEVDLLRRDFTLNALAVNEQGLVLGLPIARYDLEHRLLRAIRKANLWEDPLRSLRAVRITLTAGLRLEPHTEGWIYEHAQYLRESGALPAWERVGEELSQILRHPAAAVGFLRLERAGLLEVYLPELAAGIGVEQHGAHHLDVWRHSLEVLAQLTLLRPDAHLALRWAALLHDVAKPQTRQWSPEKGRYTFYGHDALGAEQARQILNRLRQPSEVVAEAVRLVRLHMQHPPQGGRELRRFLHRRREALPELIWLQLADMTGILGYRERVEELREQLQAIESLAEGTPSPKPLLDGREVMRLLGLEPGPKVGEALAALLEAQAIGEVQSRTEAASFLRDAFGEDKGRMS

SEQ ID NO: 4 - protein, 454 aa, Shigella flexneri
MLSREESEAEQAVARPQVTVIPREQHAISRKDISENALKVMYRLNKAGYEAWLVGGGVRDLLLGKKPKDFDVTTNATPEQVRKLFRNCRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLSMRISPETAEPIPRLATLLNDIPPARLFEESLKLLQAGYGYETYKLLCEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTT

SEQ ID NO: 5 - protein, 454 aa, Shigella dysenteriae
MLSREESEAEQAVARPQVTVIPREQHAISRKDISENALKVMYRLNKAGYEAWLVGGGVRDLLLGKKPKDFDVTTNATPEQVRKLFRNCRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLCEYHLFQPLFPTITRYFTENGDSPMERIIKQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 6 - protein, 454 aa, Citrobacter koseri
MLNREESEAELAVARPHMTVIPREQHAISRKDISENALKVMYRLNKAGYEAWLVGGGVRDLLLGKKPKDFDVTTNATPDQVRKLFRNCRLVGRRFRLAHVMFGPEIIEVATFRGHHEGNDSDRATSQRGQNGMLLRDNIFGSIEEDAQRRDFTINSLYYSVADFTVRDYVGGMQDLKDGVIRLIGNPETRYREDPVRMLRAVRFAAKLDMRISPETAEPIPRLATLLNDIPPARLFEESLKLLQAGYGFETYKKLREYSLFQPLFPTITRYFTENGDSAMERIIAQVLKNTDNRIHNDMRVNPAFLFAAMFWYPLLEMAQKIAQESGLAYYDAFALAMNEVLDEACRSLAIPKRLTTLTRDIWQLQLRMSRRQGKRAWKLLEHPKFRAAYDLLALRAEVENNAELQRLAQWWGEFQVSAPPDQKGMLNELDEDPAPRRRHRRPRKRAPRREGTA

SEQ ID NO: 7 - protein, 454 aa, Salmonella bongori
MLSREESEAEQAVARPHMTIIPREQHAISRKDISENALKVMYRLNKAGYEAWLVGGGVRDLLLGKKPKDFDVTTNATPDQVRKLFRNCRLVGRRFRLAHVMFGPEIIEVATFRGHHEGSESDRTTSQRGQNGMLLRDNIFGSIEEDAQRRDFTINSLYYSVADFTVRDYVGGMQDLKEGVIRLIGNPETRYREDPVRMLRAVRFAAKLNMRISPETAEPIPRLATLLNDIPPARLFEESLKLLQAGYGYETYKKLREYNLFQPLFPTITRYFTENGDSAMERIIAQVLKNTDTRIHNEMRVNPAFLFAAMFWYPLLEMAQKIAQESGLAYYDAFALAMNEVLDEACRSLAIPKRLTTLTRDIWQLQLRMSRRQGKRAWKLMEHPKFRAAFDLLELRAQVENNAELQRLAKWWSEFQVSAPPEQKGMLNELDDDPAPRRRRPRPRRRAPRREGAA

SEQ ID NO: 8 - protein, 443 aa, Salmonella enterica
MLSREESEAEQAVARPHMTIIPREQHAISRKDISENALKVLYRLNKAGYEAYLVGGGVRDLLLGKKPKDFDVTTNATPDQVRKLFRNCRLVGRRFRLAHVMFGPEIIEVATFRGHHEGSESDRTTSQRGQNGMLLRDNIFGSIEEDAQRRDFTINSLYYSVADFTVRDYVGGMQDLQEGVIRLIGNPETRYREDPVRMLRAVRFAAKLNMRISPETAEPIPRLATLLNDIPPARLFEESLKLLQAGNGYETYQQLREYHLFQPLFPTITRYFTENGDSAMERIIAQVLKNTDNRIRNEMRVNPAFLFAAMFWYPLLEMAQKIAQESGLAYYDAFALAMNDVLDEACRSLAIPKRLTTLTRDIWQLQLRMSRRQGKRAWKLMEHPKFRAAFDLLELRAQVENNTELQRLAQWWAEFQASAPPEQKGMLNELDDDPAPRRRRSRP

SEQ ID NO: 9 - protein, 453 aa, Trabulsiella guamensis
MLSREESEAEIVVARPKMTVIPREQHAISRKDISENALKVLYRLNKAGYEAYLVGGGVRDLLLGKKPKDFDVTTSATPDQVRKLFRNCRLVGRRFRLAHVMFGPEIIEVATFRGHHEGSSIDRTTSQRGQNGMLLRDNIFGSIEEDAQRRDFTINSLYYSVADFTVRDYVGGMQDLKDGVIRLIGNPETRYREDPVRMLRAVRFAAKLGMRISPETAEPIPRLATLINDVPPARLFEESLKLLQAGYGFETWNLLREYSLFQPLFPTITRYFTENGDSPMERIIAQVLKNTDTRIHNEMRVNPAFLFAAMFWYPLLEMAQKIAQESGLAYYDAFALATNDVLDEACRSIAIPKRITTLVRDIWQLQLRMSRRQGKRAWKLMEHPKFRAAYDLLSLRAEAEHNAELQRLTQWWGEFQVAAPPEQKDMLTDLGDEPARRRHRRPRKRTPRPGSPA

SEQ ID NO: 10 - protein, 454 aa, Kluyvera ascorbata
MLSREESEAENAVAKPAMTVIPREQHAISRKDISENALKVLYRLNKAGYEAYLVGGGVRDLLLGKKPKDFDVTTSATPDQVRKLFRNCRLVGRRFRLAHVMFGPEIIEVATFRGHHEDGQSDRTTSQRGQNGMLLRDNIFGSIEEDAQRRDFTINSLYYSVADFTVRDYVGGMQDLIDGVIRLIGDPETRYREDPVRMLRAVRFAAKLDMRISPETAEPIPRLATLMNDVPPARLFEEALKLLQAGYGFETYKLLREYNLFQPLFPTITRYFTEDGDSPMERIISQVLKNTDTRIRNDMRVNPAFLFAAMFWYPLLEMAQKIAQESGLAYYDAFALAMNEVLDEACRSLAIPKRITTLVRDIWQLQLRMSRRQGKRAWKLMEHPKFRAAYDLLALRAEAEHNGELQRLTQWWGEFQVVAPPAQKDMLNELGDEPDTRRRHRRPRKRAPRREGSS

SEQ ID NO: 11 - protein, 436 aa, Citrobacter freundii
MTVIPREQHSISRKDISENALKVMYRLNKAGYEAWLVGGGVRDLLLGKKPKDFDVTTNATPDQVRKLFRNCRLVGRRFRLAHVMFGPEIIEVATFRGHHEGSEADRTTSQRGQNGMLLRDNIFGSIEEDAQRRDFTINSLYYSVADFTVRDYVGGMQDLEEGIIRLIGNPETRYREDPVRMLRAVRFAAKLDMRISPETAEPIPRLATLLNDIPPARLFEEALKLLQAGYGYETYKKLREYSLFQPLFPTITRYFTEDGDSPMERIIAQVLKNTDNRINNDMRVNPAFLFAAMFWYPLLEAAQKIAQESGLAYYDAFALAMNDVLDEACRSLAIPKRLTSLTRDIWQLQLRMSRRQGKRAWKLMEHPKFRAAYDLLALRAEVENNAELQRLAQWWGEFQVSAPPEQKGMLNELDEEPERRRHRRPRKRAPRREGSA

SEQ ID NO: 12 - protein, 447 aa, Enterobacter cloacae
MANDAIAQPHMSVIPREQHTISRKDISENALKVLYRLNKAGYEAYLVGGGVRDLLLGKKPKDFDVTTSATPEQVRKLFRNCRLVGRRFRLAHVMFGPEIIEVATFRGHHEAGASDRTTSQRGQNGMLLRDNIFGSIEEDAQRRDFTINSLYYSVADFTVRDYVGGMQDLKEGLIRLIGTPETRYREDPVRMLRAVRFAAKLNMRISPETAEPIPRLATLINDVPPARLFEEALKLLQAGHGFDTYNLLREYNLFQPLFPTITRYFTENGDSPMERMIAQVLKNTDTRIRNDMRVNPAFLFAAMFWYPLLETAQRITQESGLAYYDAFALAANDVLDEGCRTLAIPKRITTLVRDIWQLQLRMSRRQGKRAWKLMEHPKFRAAFDLLSLRAEIERNQELQRLSQWWAEFQVSAPPEQKDMLTGLDEEPEPRRRHRRPRKRAPRREGTA

SEQ ID NO: 13 - protein, 436 aa, Enterococcus gallinarum
MTVIPREQHAISRKDISENALKVMYRLNKAGYESWLVGGGVRDLLLGKKPKDFDVTTNATPDQVRKLFRNCRLVGRRFRLAHVMFGPEIIEVATFRGHHEGHTTDRVTSQRGQNGMLLRDNIFGSIEEDAQRRDFTINSLYYSVADFTVRDYVGGMKDLQDGVIRLIGNPETRYREDPVRMLRAVRFAAKLNMTISPETAEPLPRLAALLHDVPPARLFEEVLKLLQAGYGYQTYMLLREYSLFQPLFPTITRYFTERGDSPMERIISQVLKNTDTRIHNDMRVNPAFLFAVMFWYPLLETAQKIAQESGLAYYDAFALAMNDVLDEACRTLAIPKRITTLIRDIWQLQLRMSRRQGKRAWKLMEHPKFRAAYDLLELRAGAENNHELQRLTKWWGEFQVAAPPAQKDMLNDLGDDPAPRRRHRRPRKRAPRQGSA

SEQ ID NO: 14 - protein, 455 aa, Grimontia indica
MNRDNKTRAIDDLKLEVIPRQEHGISRKDISENALKVLYRLNKAGFEAYLVGGGVRDLLLNKQPKDFDIATNATPEEVRKLFRNCRLVGRRFRLAHILFGRDVIEVATFRGHHGADKGDKSASQSNDGMLLRDNVYGTIDEDAERRDFTVNALYYNIDDFSVRDYAGGVEDLKNRVIRLIGDPETRYREDPVRMLRAVRFAAKLDMQINEATAAPIPALAHLLRDIPAARLFEESLKLLQSGNGLDTYRLLRDYNLFSPLFPILDEHFTEDRSSKCEKMLELVLKSTDDRVANDQRINPAFMYAAMLWYPLETRAEEIAFESGLSYYDAFMVAANDILDEQVKSIAIPRRFTAMIRDIWQLQLRLSRRSGNRAYKLLEQNKFRAAFDFLEMRGKIEGGQLEELATWWDDFQRANRDDRHDMVQVLNKASAAKKTRRRRKTKPRSRKPKPKSNTES

SEQ ID NO: 15 - protein, 457 aa, Salinivibrio costicola
MNRDGKTRAIEDLKLEVIPRKAHGISRKGISENALKVLYRLHKAGYEAYLVGGGVRDLLLDREPKDFDIATNATPDEVRKLFRNCRLIGRRFRLAHILFGRDVIEVATFRGHHGKSEPDKKDKQTARSEDGMLLRDNVYGTIDEDAQRRDFTINGLYYNIADFSIRDYAGGLDDLNNRVVRLIGDPETRYREDPVRMLRAVRFAVKLDMTINDATAAPMVELAPLLQDIPAARMFEESLKLLQAGQGLATYQMLREYNLFQQLFPAVAAHFTEAQTSQTEQMLEQVLRSTDKRVANDQRINPAFLFAAMLWYPLVTRAEEMAFESGLSYYDAFMVAASDIVDEQVKTVAIPRRFTAMVREVWQLQMRMTRRTGARAFKTLEEKKFRAAFDLLEMRGAVEGDDTEALCAWWRDFQRADQGGRQKMVRAINKVSNTRSPKSRRRKGPPRRRKPQSNSDA

SEQ ID NO: 16 - protein, 454 aa, Artificial sequence
  Escherichia coli pcnB C88A C256A
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 17 - protein, 455 aa, Artificial sequence
  Escherichia coli pcnB C88A C256A C346A 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 18 - protein, 461 aa, Artificial sequence
  Escherichia coli pcnB C88A C256A C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 19 - protein, 439 aa, Artificial sequence
  Thermus aquaticus poly(A) polymerase C190A 439C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLAKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGC

SEQ ID NO: 20 - protein, 445 aa, Artificial sequence
  Thermus aquaticus poly(A) polymerase C190A 439(6xG)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLAKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGGGC

SEQ ID NO: 21 - protein, 436 aa, Artificial sequence
  Meiothermus silvanus polynucleotide adenylyltransferase 436C
MLVAIRRVHLSPFPFPAQGYLVGGAVRDLMLGKRPKDLDFVVPNPEEAARDLAHRLGGSIFPLDEKRRFWRVVAPGTTYDYAPMPQGLEVDLLRRDFTLNALAVNEQGLVLGLPIARYDLEHRLLRAIRKANLWEDPLRSLRAVRITLTAGLRLEPHTEGWIYEHAQYLRESGALPAWERVGEELSQILRHPAAAVGFLRLERAGLLEVYLPELAAGIGVEQHGAHHLDVWRHSLEVLAQLTLLRPDAHLALRWAALLHDVAKPQTRQWSPEKGRYTFYGHDALGAEQARQILNRLRQPSEVVAEAVRLVRLHMQHPPQGGRELRRFLHRRREALPELIWLQLADMTGILGYRERVEELREQLQAIESLAEGTPSPKPLLDGREVMRLLGLEPGPKVGEALAALLEAQAIGEVQSRTEAASFLRDAFGEDKGRMSC

SEQ ID NO: 22 - protein, 442 aa, Artificial sequence
  Meiothermus silvanus polynucleotide adenylyltransferase 436 (6xG)C
MLVAIRRVHLSPFPFPAQGYLVGGAVRDLMLGKRPKDLDFVVPNPEEAARDLAHRLGGSIFPLDEKRRFWRVVAPGTTYDYAPMPQGLEVDLLRRDFTLNALAVNEQGLVLGLPIARYDLEHRLLRAIRKANLWEDPLRSLRAVRITLTAGLRLEPHTEGWIYEHAQYLRESGALPAWERVGEELSQILRHPAAAVGFLRLERAGLLEVYLPELAAGIGVEQHGAHHLDVWRHSLEVLAQLTLLRPDAHLALRWAALLHDVAKPQTRQWSPEKGRYTFYGHDALGAEQARQILNRLRQPSEVVAEAVRLVRLHMQHPPQGGRELRRFLHRRREALPELIWLQLADMTGILGYRERVEELREQLQAIESLAEGTPSPKPLLDGREVMRLLGLEPGPKVGEALAALLEAQAIGEVQSRTEAASFLRDAFGEDKGRMSGGGGGGC

SEQ ID NO: 23 - RNA, 1955 nt, Artificial sequence
  hemagglutinin influenza A virus 5'-TOP-UTR GC-optimized polyA_signal poly(C)_signal
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucu

SEQ ID NO: 24 - protein, 454 aa, Artificial sequence
  Escherichia coli pcnB C88S C256S
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 25 - protein, 454 aa, Artificial sequence
  Escherichia coli pcnB C88A C256S
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 26 - protein, 454 aa, Artificial sequence
  Escherichia coli pcnB C88S C256A
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 27 - protein, 454 aa, Artificial sequence
  Escherichia coli pcnB C88V C256V
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 28 - protein, 454 aa, Artificial sequence
  Escherichia coli pcnB C88A C256V
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 29 - protein, 454 aa, Artificial sequence
  Escherichia coli pcnB C88S C256V
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 30 - protein, 454 aa, Artificial sequence
  Escherichia coli pcnB C88V C256A
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 31 - protein, 454 aa, Artificial sequence
  Escherichia coli pcnB C88V C256S
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 32 - protein, 455 aa, Artificial sequence
  Escherichia coli pcnB C88S C256S C346S 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 33 - protein, 455 aa, Artificial sequence
  Escherichia coli pcnB C88A C256S C346S 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 34 - protein, 455 aa, Artificial sequence
  Escherichia coli pcnB C88S C256A C346S 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 35 - protein, 455 aa, Artificial sequence
  Escherichia coli pcnB C88S C256S C346A 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 36 - protein, 455 aa, Artificial sequence
  Escherichia coli pcnB C88A C256A C346S 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 37 - protein, 455 aa, Artificial sequence
  Escherichia coli pcnB C88S C256A C346A 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 38 - protein, 455 aa, Artificial sequence
  Escherichia coli pcnB C88A C256S C346A 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 39 - protein, 455 aa, Artificial sequence
  Escherichia coli pcnB C88V C256V C346V 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 40 - protein, 455 aa, Artificial sequence
  Escherichia coli pcnB C88A C256V C346V 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 41 - protein, 455 aa, Artificial sequence
  Escherichia coli pcnB C88V C256A C346V 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 42 - protein, 455 aa, Artificial sequence
  Escherichia coli pcnB C88V C256V C346A 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 43 - protein, 455 aa, Artificial sequence
  Escherichia coli pcnB C88A C256A C346V 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 44 - protein, 455 aa, Artificial sequence
  Escherichia coli pcnB C88V C256A C346A 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 45 - protein, 455 aa, Artificial sequence
  Escherichia coli pcnB C88A C256V C346A 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 46 - protein, 455 aa, Artificial sequence
  Escherichia coli pcnB C88S C256S C346V 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 47 - protein, 455 aa, Artificial sequence
  Escherichia coli pcnB C88S C256A C346V 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 48 - protein, 455 aa, Artificial sequence
  Escherichia coli pcnB C88A C256S C346V 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 49 - protein, 455 aa, Artificial sequence
  Escherichia coli pcnB C88S C256V C346S 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 50 - protein, 455 aa, Artificial sequence
  Escherichia coli pcnB C88S C256V C346A 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 51 - protein, 455 aa, Artificial sequence
  Escherichia coli pcnB C88A C256V C346S 455C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 52 - protein, 455 aa, Artificial sequence
  Escherichia coli pcnB C88V C256S C346S 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 53 - protein, 455 aa, Artificial sequence
  Escherichia coli pcnB C88V C256S C346A 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 54 - protein, 455 aa, Artificial sequence
  Escherichia coli pcnB C88V C256A C346S 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 55 - protein, 455 aa, Artificial sequence
  Escherichia coli pcnB C88V C256V C346S 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 56 - protein, 455 aa, Artificial sequence
  Escherichia coli pcnB C88V C256S C346V 455C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 57 - protein, 455 aa, Artificial sequence
  Escherichia coli pcnB C88S C256V C346V 455C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAC

SEQ ID NO: 58 - protein, 461 aa, Artificial sequence
  Escherichia coli pcnB C88S C256S C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 59 - protein, 461 aa, Artificial sequence
  Escherichia coli pcnB C88A C256S C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 60 - protein, 461 aa, Artificial sequence
  Escherichia coli pcnB C88S C256A C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 61 - protein, 461 aa, Artificial sequence
  Escherichia coli pcnB C88S C256S C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 62 - protein, 461 aa, Artificial sequence
  Escherichia coli pcnB C88A C256A C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 63 - protein, 461 aa, Artificial sequence
  Escherichia coli pcnB C88S C256A C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 64 - protein, 461 aa, Artificial sequence
  Escherichia coli pcnB C88A C256S C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 65 - protein, 461 aa, Artificial sequence
  Escherichia coli pcnB C88V C256V C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 66 - protein, 461 aa, Artificial sequence
  Escherichia coli pcnB C88A C256V C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 67 - protein, 461 aa, Artificial sequence
  Escherichia coli pcnB C88V C256A C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 68 - protein, 461 aa, Artificial sequence
  Escherichia coli pcnB C88V C256V C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 69 - protein, 461 aa, Artificial sequence
  Escherichia coli pcnB C88A C256A C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 70 - protein, 461 aa, Artificial sequence
  Escherichia coli pcnB C88V C256A C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 71 - protein, 461 aa, Artificial sequence
  Escherichia coli pcnB C88A C256V C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 72 - protein, 461 aa, Artificial sequence
  Escherichia coli pcnB C88S C256S C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 73 - protein, 461 aa, Artificial sequence
  Escherichia coli pcnB C88S C256A C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 74 - protein, 461 aa, Artificial sequence
  Escherichia coli pcnB C88A C256S C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 75 - protein, 461 aa, Artificial sequence
  Escherichia coli pcnB C88S C256V C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 76 - protein, 461 aa, Artificial sequence
  Escherichia coli pcnB C88S C256V C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 77 - protein, 461 aa, Artificial sequence
  Escherichia coli pcnB C88A C256V C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 78 - protein, 461 aa, Artificial sequence
  Escherichia coli pcnB C88V C256S C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 79 - protein, 461 aa, Artificial sequence
  Escherichia coli pcnB C88V C256S C346A 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 80 - protein, 461 aa, Artificial sequence
  Escherichia coli pcnB C88V C256A C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 81 - protein, 461 aa, Artificial sequence
  Escherichia coli pcnB C88V C256V C346S 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 82 - protein, 461 aa, Artificial sequence
  Escherichia coli pcnB C88V C256S C346V 455 (6xG)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 83 - protein, 461 aa, Artificial sequence
  Escherichia coli pcnB C88S C256V C346V  455 (6xG)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 84 - protein, 461 aa, Artificial sequence
  Escherichia coli pcnB (6xG)C
MLSREESEAEQAVARPQVTVIPREQHAISRKDISENALKVMYRLNKAGYEAWLVGGGVRDLLLGKKPKDFDVTTNATPEQVRKLFRNCRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLCEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGGGC

SEQ ID NO: 85 - protein, 465 aa, Artificial sequence
  Escherichia coli pcnB C88A C256A C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 86 - protein, 465 aa, Artificial sequence
  Escherichia coli pcnB C88S C256S C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 87 - protein, 465 aa, Artificial sequence
  Escherichia coli pcnB C88A C256S C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 88 - protein, 465 aa, Artificial sequence
  Escherichia coli pcnB C88S C256A C346S 455(flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 89 - protein, 465 aa, Artificial sequence
  Escherichia coli pcnB C88S C256S C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 90 - protein, 465 aa, Artificial sequence
  Escherichia coli pcnB C88A C256A C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 91 - protein, 465 aa, Artificial sequence
  Escherichia coli pcnB C88S C256A C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 92 - protein, 465 aa, Artificial sequence
  Escherichia coli pcnB C88A C256S C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 93 - protein, 465 aa, Artificial sequence
  Escherichia coli pcnB C88V C256V C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 94 - protein, 465 aa, Artificial sequence
  Escherichia coli pcnB C88A C256V C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 95 - protein, 465 aa, Artificial sequence
  Escherichia coli pcnB C88V C256A C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 96 - protein, 465 aa, Artificial sequence
  Escherichia coli pcnB C88V C256V C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 97 - protein, 465 aa, Artificial sequence
  Escherichia coli pcnB C88A C256A C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 98 - protein, 465 aa, Artificial sequence
  Escherichia coli pcnB C88V C256A C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 99 - protein, 465 aa, Artificial sequence
  Escherichia coli pcnB C88A C256V C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 100 - protein, 465 aa, Artificial sequence
  Escherichia coli pcnB C88S C256S C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 101 - protein, 465 aa, Artificial sequence
  Escherichia coli pcnB C88S C256A C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 102 - protein, 465 aa, Artificial sequence
  Escherichia coli pcnB C88A C256S C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 103 - protein, 465 aa, Artificial sequence
  Escherichia coli pcnB C88S C256V C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 104 - protein, 465 aa, Artificial sequence
  Escherichia coli pcnB C88S C256V C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 105 - protein, 465 aa, Artificial sequence
  Escherichia coli pcnB C88A C256V C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 106 - protein, 465 aa, Artificial sequence
  Escherichia coli pcnB C88V C256S C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 107 - protein, 465 aa, Artificial sequence
  Escherichia coli pcnB C88V C256S C346A 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 108 - protein, 465 aa, Artificial sequence
  Escherichia coli pcnB C88V C256A C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 109 - protein, 465 aa, Artificial sequence
  Escherichia coli pcnB C88V C256V C346S 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 110 - protein, 465 aa, Artificial sequence
  Escherichia coli pcnB C88V C256S C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 111 - protein, 465 aa, Artificial sequence
  Escherichia coli pcnB C88S C256V C346V 455 (flexLinker)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 112 - protein, 465 aa, Artificial sequence
  Escherichia coli pcnB (flexLinker)C
MLSREESEAEQAVARPQVTVIPREQHAISRKDISENALKVMYRLNKAGYEAWLVGGGVRDLLLGKKPKDFDVTTNATPEQVRKLFRNCRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLCEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSC

SEQ ID NO: 113 - protein, 471 aa, Artificial sequence
  Escherichia coli pcnB C88A C256A C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 114 - protein, 471 aa, Artificial sequence
  Escherichia coli pcnB C88S C256S C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 115 - protein, 471 aa, Artificial sequence
  Escherichia coli pcnB C88A C256S C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 116 - protein, 471 aa, Artificial sequence
  Escherichia coli pcnB C88S C256A C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 117 - protein, 471 aa, Artificial sequence
  Escherichia coli pcnB C88S C256S C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 118 - protein, 471 aa, Artificial sequence
  Escherichia coli pcnB C88A C256A C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 119 - protein, 471 aa, Artificial sequence
  Escherichia coli pcnB C88S C256A C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 120 - protein, 471 aa, Artificial sequence
  Escherichia coli pcnB C88A C256S C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 121 - protein, 471 aa, Artificial sequence
  Escherichia coli pcnB C88V C256V C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 122 - protein, 471 aa, Artificial sequence
  Escherichia coli pcnB C88A C256V C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 123 - protein, 471 aa, Artificial sequence
  Escherichia coli pcnB C88V C256A C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 124 - protein, 471 aa, Artificial sequence
  Escherichia coli pcnB C88V C256V C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 125 - protein, 471 aa, Artificial sequence
  Escherichia coli pcnB C88A C256A C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 126 - protein, 471 aa, Artificial sequence
  Escherichia coli pcnB C88V C256A C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 127 - protein, 471 aa, Artificial sequence
  Escherichia coli pcnB C88A C256V C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 128 - protein, 471 aa, Artificial sequence
  Escherichia coli pcnB C88S C256S C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 129 - protein, 471 aa, Artificial sequence
  Escherichia coli pcnB C88S C256A C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 130 - protein, 471 aa, Artificial sequence
  Escherichia coli pcnB C88A C256S C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 131 - protein, 471 aa, Artificial sequence
  Escherichia coli pcnB C88S C256V C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 132 - protein, 471 aa, Artificial sequence
  Escherichia coli pcnB C88S C256V C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 133 - protein, 471 aa, Artificial sequence
  Escherichia coli pcnB C88A C256V C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNARLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 134 - protein, 471 aa, Artificial sequence
  Escherichia coli pcnB C88V C256S C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 135 - protein, 471 aa, Artificial sequence
  Escherichia coli pcnB C88V C256S C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 136 - protein, 471 aa, Artificial sequence
  Escherichia coli pcnB C88V C256A C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLAEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 137 - protein, 471 aa, Artificial sequence
  Escherichia coli pcnB C88V C256V C346S 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEASRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 138 - protein, 471 aa, Artificial sequence
  Escherichia coli pcnB C88V C256S C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNVRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLSEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 139 - protein, 471 aa, Artificial sequence
  Escherichia coli pcnB C88S C256V C346V 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLVEYHLFQPLFPTITRYFTENGDSPMERIIEQVLKNTDTRIHNDMRVNPAFLFAAMFWYPLLETAQKIAQESGLTYHDAFALAMNDVLDEAVRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 140 - protein, 471 aa, Artificial sequence
  Escherichia coli pcnB  (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNCRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLCEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

SEQ ID NO: 141 - protein, 439 aa, Artificial sequence
  Thermus aquaticus poly(A) polymerase C190S 439C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLSKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGC

SEQ ID NO: 142 - protein, 439 aa, Artificial sequence
  Thermus aquaticus poly(A) polymerase C190V 439C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLVKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGC

SEQ ID NO: 143 - protein, 445 aa, Artificial sequence
  Thermus aquaticus poly(A) polymerase C190S 439(6xG)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLSKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGGGC

SEQ ID NO: 144 - protein, 445 aa, Artificial sequence
  Thermus aquaticus poly(A) polymerase C190V 439(6xG)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLVKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGGGC

SEQ ID NO: 145 - protein, 445 aa, Artificial sequence
  Thermus aquaticus poly(A) polymerase 439(6xG)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLCKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGGGC

SEQ ID NO: 146 - protein, 448 aa, Artificial sequence
  Thermus aquaticus poly(A) polymerase C190A 439(flex linker)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLAKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGC

SEQ ID NO: 147 - protein, 448 aa, Artificial sequence
  Thermus aquaticus poly(A) polymerase C190S 439(flex linker)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLSKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGC

SEQ ID NO: 148 - protein, 448 aa, Artificial sequence
  Thermus aquaticus poly(A) polymerase C190V 439(flex linker)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLVKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGC

SEQ ID NO: 149 - protein, 448 aa, Artificial sequence
  Thermus aquaticus poly(A) polymerase 439(flex linker)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLCKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGC

SEQ ID NO: 150 - protein, 455 aa, Artificial sequence
  Thermus aquaticus poly(A) polymerase C190A 439(flex linker+HIS)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLAKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGSHHHHHHC

SEQ ID NO: 151 - protein, 455 aa, Artificial sequence
  Thermus aquaticus poly(A) polymerase C190S 439(flex linker+HIS)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLSKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGSHHHHHHC

SEQ ID NO: 152 - protein, 455 aa, Artificial sequence
  Thermus aquaticus poly(A) polymerase C190V 439(flex linker+HIS)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLVKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGSHHHHHHC

SEQ ID NO: 153 - protein, 455 aa, Artificial sequence
  Thermus aquaticus poly(A) polymerase 439(flex linker+HIS)C
MLRLIAHRDFPFYTPKGAIPVGGALRDLLLGERPLDLDFAAWDPEKAAEEAKGRYGGTLFPLDPERGHYRLVAGALTLDFTPLEGSPEEDLLRRDYRVNALLWLKGRVFGLPGAEEDLNRRLLVPVQEENLYADPLRSLRGVRLAATLGLGLPPETRRALARHARFLQENPSALPARERVREELAKLLLCKRAPFGLHLLERTGLLGIYLPELTHLVGLHQGGVHHLPAWEHTLSVLFHLLWLWPEAPLEARLAALYHDAGKPLTRRYDPEVGRYRFFGHAEVGAEMAKAALFWLRFPKEVVEKAAHLVRRHMDRPPEGTKALRRFYFKRRDLLPALPYLMAADRLAAKGVEAEAWPLLEAYREALKTPLPQEPLLSGEEVMALLGLRPGPLVGEALRALLEAQAEGSVASQEEARRFLLYWRDGRTAQATPAPDHPGGGGGSGGGGSHHHHHHC

SEQ ID NO: 154 - protein, 446 aa, Artificial sequence
  Meiothermus silvanus polynucleotide adenylyltransferase 436 (flex linker)C
MLVAIRRVHLSPFPFPAQGYLVGGAVRDLMLGKRPKDLDFVVPNPEEAARDLAHRLGGSIFPLDEKRRFWRVVAPGTTYDYAPMPQGLEVDLLRRDFTLNALAVNEQGLVLGLPIARYDLEHRLLRAIRKANLWEDPLRSLRAVRITLTAGLRLEPHTEGWIYEHAQYLRESGALPAWERVGEELSQILRHPAAAVGFLRLERAGLLEVYLPELAAGIGVEQHGAHHLDVWRHSLEVLAQLTLLRPDAHLALRWAALLHDVAKPQTRQWSPEKGRYTFYGHDALGAEQARQILNRLRQPSEVVAEAVRLVRLHMQHPPQGGRELRRFLHRRREALPELIWLQLADMTGILGYRERVEELREQLQAIESLAEGTPSPKPLLDGREVMRLLGLEPGPKVGEALAALLEAQAIGEVQSRTEAASFLRDAFGEDKGRMSGGGGSGGGGSC

SEQ ID NO: 155 - protein, 452 aa, Artificial sequence
  Meiothermus silvanus polynucleotide adenylyltransferase 436 (flex linker+HIS)C
MLVAIRRVHLSPFPFPAQGYLVGGAVRDLMLGKRPKDLDFVVPNPEEAARDLAHRLGGSIFPLDEKRRFWRVVAPGTTYDYAPMPQGLEVDLLRRDFTLNALAVNEQGLVLGLPIARYDLEHRLLRAIRKANLWEDPLRSLRAVRITLTAGLRLEPHTEGWIYEHAQYLRESGALPAWERVGEELSQILRHPAAAVGFLRLERAGLLEVYLPELAAGIGVEQHGAHHLDVWRHSLEVLAQLTLLRPDAHLALRWAALLHDVAKPQTRQWSPEKGRYTFYGHDALGAEQARQILNRLRQPSEVVAEAVRLVRLHMQHPPQGGRELRRFLHRRREALPELIWLQLADMTGILGYRERVEELREQLQAIESLAEGTPSPKPLLDGREVMRLLGLEPGPKVGEALAALLEAQAIGEVQSRTEAASFLRDAFGEDKGRMSGGGGSGGGGSHHHHHHC

SEQ ID NO: 156 - protein, 26 aa, Artificial sequence
  linker
SGGGSGGGGSGGGGSGGGGSGGGSLQ

SEQ ID NO: 157 - protein, 12 aa, Artificial sequence
  Rigid-linker_AEAAAKEAAAKA
AEAAAKEAAAKA

SEQ ID NO: 158 - protein, 46 aa, Artificial sequence
  Rigid-linker
AEAAAKEAAAKEAAAKEAAAKALEAEAAAKEAAAKEAAAKEAAAKA

SEQ ID NO: 159 - protein, 5 aa, Artificial sequence
  Rigid-linker (EAAAK)1
EAAAK

SEQ ID NO: 160 - protein, 10 aa, Artificial sequence
  Rigid-linker (EAAAK)2
EAAAKEAAAK

SEQ ID NO: 161 - protein, 15 aa, Artificial sequence
  Rigid-linker (EAAAK)3
EAAAKEAAAKEAAAK

SEQ ID NO: 162 - protein, 4 aa, Artificial sequence
  Linker-GGG(GC)
GGGG

SEQ ID NO: 163 - protein, 5 aa, Artificial sequence
  Linker-GGGGG(GC)
GGGGG

SEQ ID NO: 164 - protein, 6 aa, Artificial sequence
  Gly-linker (G)6
GGGGGG

SEQ ID NO: 165 - protein, 8 aa, Artificial sequence
  Gly-linker (G)8
GGGGGGGG

SEQ ID NO: 166 - protein, 5 aa, Artificial sequence
  Linker GGGS
GGGGS

SEQ ID NO: 167 - protein, 6 aa, Artificial sequence
  Linker-G4SG
GGGGSG

SEQ ID NO: 168 - protein, 9 aa, Artificial sequence
  Linker-G4SG4(GC)
GGGGSGGGG

SEQ ID NO: 169 - protein, 10 aa, Artificial sequence
  Linker-(G4S)2
GGGGSGGGGS

SEQ ID NO: 170 - protein, 10 aa, Artificial sequence
  Linker (GGGGS)2
GGGGSGGGGS

SEQ ID NO: 171 - protein, 15 aa, Artificial sequence
  Linker-(GGGGS)3
GGGGSGGGGSGGGGS

SEQ ID NO: 172 - protein, 20 aa, Artificial sequence
  Linker (GGGGS)4
GGGGSGGGGSGGGGSGGGGS

SEQ ID NO: 173 - protein, 16 aa, Artificial sequence
  Linker-GGGSGGGGSGGGGSGG(GC)
GGGSGGGGSGGGGSGG

SEQ ID NO: 174 - protein, 15 aa, Artificial sequence
  Linker-GGSGGGGSGGGGSGG
GGSGGGGSGGGGSGG

SEQ ID NO: 175 - protein, 4 aa, Artificial sequence
  Linker-GSG
GSGS

SEQ ID NO: 176 - protein, 21 aa, Artificial sequence
  Linker(GC)
GSGGGGSAWSHPQFEKGGGGS

SEQ ID NO: 177 - protein, 5 aa, Artificial sequence
  Rigid-linker
PAPAP

SEQ ID NO: 178 - protein, 11 aa, Artificial sequence
  Linker-PPPGSRHDKIH(GC)
PPPGSRHDKIH

SEQ ID NO: 179 - protein, 4 aa, Artificial sequence
  Linker-SGG(GC)
SGGG

SEQ ID NO: 180 - protein, 4 aa, Artificial sequence
  Linker-SGS
GSGS

SEQ ID NO: 181 - protein, 17 aa, Artificial sequence
  19-A
EWLKAFYEKVLEKLKEL

SEQ ID NO: 182 - protein, 15 aa, Artificial sequence
  Avi-Tag
GLNDIFEAQKIEWHE

SEQ ID NO: 183 - protein, 26 aa, Artificial sequence
  Calmodulin Tag
KRRWKKNFIAVSAANRFKKISSSGAL

SEQ ID NO: 184 - protein, 13 aa, Artificial sequence
  E-tag
GAPVPYPDPLEPR

SEQ ID NO: 185 - protein, 16 aa, Artificial sequence
  ELK16-Tag
LELELKLKLELELKLK

SEQ ID NO: 186 - protein, 8 aa, Artificial sequence
  FLAG tag
DYKDDDDK

SEQ ID NO: 187 - protein, 6 aa, Artificial sequence
  Poly-Glutamate-Tag
EEEEEE

SEQ ID NO: 188 - protein, 9 aa, Artificial sequence
  HA-tag
YPYDVPDYA

SEQ ID NO: 189 - protein, 6 aa, Artificial sequence
  HIS tag
HHHHHH

SEQ ID NO: 190 - protein, 16 aa, Artificial sequence
  Isopeptag
TDKDMTITFTNKKDAE

SEQ ID NO: 191 - protein, 10 aa, Artificial sequence
  Myc Tag
EQKLISEEDL

SEQ ID NO: 192 - protein, 15 aa, Artificial sequence
  S-tag
KETAAAKFERQHMDS

SEQ ID NO: 193 - protein, 38 aa, Artificial sequence
  SBP tag
MDEKTTGWRGGHVVEGLAGELEQLRARLEHHPQGQREP

SEQ ID NO: 194 - protein, 13 aa, Artificial sequence
  Spy Tag
AHIVMVDAYKPTK

SEQ ID NO: 195 - protein, 13 aa, Artificial sequence
  SofTag 1
SLAELLNAGLGGS

SEQ ID NO: 196 - protein, 8 aa, Artificial sequence
  Sof Tag 2
TQDPSRVG

SEQ ID NO: 197 - protein, 8 aa, Artificial sequence
  Strep-II-Tag
WSHPQFEK

SEQ ID NO: 198 - protein, 11 aa, Artificial sequence
  T7 Epitope tag
MASMTGGQQMG

SEQ ID NO: 199 - protein, 14 aa, Artificial sequence
  V5 Tag
GKPIPNPLLGLDST

SEQ ID NO: 200 - protein, 11 aa, Artificial sequence
  VSV Tag
YTDIEMNRLGK

SEQ ID NO: 201 - protein, 8 aa, Artificial sequence
  Xpress Tag
DLYDDDDK

SEQ ID NO: 202 - RNA, 60 nt, Artificial sequence
  RNA template
gccaccuccgcugaugaggccucgaccgauaggucgaggucgaggccgaaaggcagcgcc

SEQ ID NO: 203 - protein, 471 aa, Artificial sequence
  Escherichia coli pcnB C88S C256R C346A 455 (flexLinker+HIS)C
MLSREESEAEQAVARPQVTVIPREQHAISRKDISENALKVMYRLNKAGYEAWLVGGGVRDLLLGKKPKDFDVTTNATPEQVRKLFRNSRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREDPVRMLRAVRFAAKLGMRISPETAEPIPRLATLLNDIPPARLFEESLKLLQAGYGYETYKLLREYHLFQPLFPTITRYFTENGDSPMERIIEQVLKNTDTRIHNDMRVNPAFLFAAMFWYPLLETAQKIAQESGLTYHDAFALAMNDVLDEAARSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTAGGGGSGGGGSHHHHHHC

The invention claimed is:

1. A method of producing polyadenylated ribonucleic acid (poly(A)RNA) molecules comprising contacting an RNA molecule with a poly(A)polymerase covalently immobilized onto a solid support, said poly(A)polymerase comprising at least 90% sequence identity to SEQ ID NO: 113, wherein the poly(A)polymerase comprises at least one newly introduced cysteine residue compared to a native poly(A)polymerase, wherein the at least one newly introduced cysteine residue is located at a terminus of the protein, wherein the poly(A) polymerase is immobilized via a thiol group of the at least one newly introduced cysteine residue, and wherein the at least one cysteine residue is attached to the poly(A)polymerase via a peptide linker element comprising the sequence of SEQ ID NO: 162 (GlyGlyGlyGly), and, wherein at least 80% of the produced poly(A)RNA has a poly(A) length of at least 100 nucleotides.

2. The method according to claim 1, wherein the poly(A) polymerase is immobilized by covalent binding to a thiol-activated solid support.

3. The method according to claim 1, wherein the covalent binding is a disulfide bridge, thioester bond or a thioether bond.

4. The method according to claim 1, wherein the solid support comprises a member selected from the group consisting of sepharose, thiopropyl-sepharose, sephadex, agarose, silica, magnetic beads, methacrylate beads, and nanoparticles, preferably the solid support comprises a member selected from the group consisting of sepharose, thiopropyl-sepharose, sephadex, agarose, silica, magnetic beads, and nanoparticles.

5. The method according to claim 1, wherein the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, maleimide-activated agarose and mixtures thereof.

6. The method according to claim 1, wherein the poly(A) polymerase comprises an amino acid sequence having at least 95% sequence identity to the amino acid sequence of SEQ ID NO:113.

7. The method according to claim 1, wherein the poly(A) polymerase comprises only one cysteine residue.

8. The method according to claim 1, wherein the peptide linker element comprises the sequence of SEQ ID NO: 168 (Gly$_4$SerGly$_4$).

9. The method according to claim 1, wherein the poly(A) polymerase comprises a purification tag as depicted in SEQ ID NOs: 181-201.

10. The method of claim 1, wherein the poly(A)polymerase is immobilized onto the solid support through a single cysteine residue.

11. The method of claim 1, wherein each of the poly(A) RNA molecules comprises at least 120 adenylates.

12. The method of claim 1, wherein the poly(A)polymerase covalently immobilized onto a solid support is used for more than one enzymatic polyadenylation cycle.

13. The method of claim 1, wherein the method comprises at least one ATP feeding step.

14. The method of claim 6, wherein the poly(A)polymerase comprises only one cysteine residue.

15. The method of claim 6, wherein the poly(A)polymerase comprises an amino acid sequence having at least 98% sequence identity to the amino acid sequence of SEQ ID NO:113.

16. The method of claim 15, wherein the poly(A)polymerase comprises the amino acid sequence of SEQ ID NO: 113.

17. The method of claim 1, wherein the RNA molecule comprises a 5' Cap.

* * * * *